United States Patent
Brezski et al.

(10) Patent No.: US 10,781,246 B2
(45) Date of Patent: Sep. 22, 2020

(54) COMPOSITIONS AND METHODS FOR ANTI-STAPHYLOCOCCAL BIOLOGIC AGENTS

(71) Applicants: NEW YORK UNIVERSITY, New York, NY (US); JANSSEN BIOTECH, INC., Horsham, PA (US)

(72) Inventors: Randall J. Brezski, Alameda, CA (US); Anthony S. Lynch, Spring House, PA (US); Peter T. Buckley, Spring House, PA (US); Jeffrey Fernandez, Spring House, PA (US); Jinquan Luo, Spring House, PA (US); Thomas J. Malia, Spring House, PA (US); Sheng-Jiun Wu, Spring House, PA (US); Victor J. Torres, New York, NY (US)

(73) Assignees: NEW YORK UNIVERSITY, New York, NY (US); JANSSEN BIOTECH, INC., Horsham, PA (US)

( * ) Notice: Subject to any disclaimer, the term of this patent is extended or adjusted under 35 U.S.C. 154(b) by 0 days.

(21) Appl. No.: 15/579,860

(22) PCT Filed: Jun. 4, 2016

(86) PCT No.: PCT/US2016/035931
§ 371 (c)(1),
(2) Date: Dec. 5, 2017

(87) PCT Pub. No.: WO2016/197071
PCT Pub. Date: Dec. 8, 2016

(65) Prior Publication Data
US 2019/0127444 A1 May 2, 2019

Related U.S. Application Data

(60) Provisional application No. 62/171,788, filed on Jun. 5, 2015.

(51) Int. Cl.
| | | |
|---|---|---|
| *C07K 14/78* | (2006.01) | |
| *C07K 14/31* | (2006.01) | |
| *C07K 16/12* | (2006.01) | |
| *G01N 33/569* | (2006.01) | |
| *A61K 38/00* | (2006.01) | |

(52) U.S. Cl.
CPC ............. *C07K 14/78* (2013.01); *C07K 14/31* (2013.01); *C07K 16/1271* (2013.01); *G01N 33/56938* (2013.01); *A61K 38/00* (2013.01); *C07K 2319/21* (2013.01); *C07K 2319/33* (2013.01); *C07K 2319/43* (2013.01); *G01N 2333/31* (2013.01); *G01N 2800/26* (2013.01)

(58) Field of Classification Search
None
See application file for complete search history.

(56) References Cited

U.S. PATENT DOCUMENTS

| | | |
|---|---|---|
| 7,608,276 B2 | 10/2009 | Masignani et al. |
| 9,783,582 B2 | 10/2017 | Torres et al. |
| 10,316,067 B2 | 6/2019 | Torres et al. |
| 2010/0216708 A1 | 8/2010 | Jacobs et al. |
| 2011/0274693 A1 | 11/2011 | Torres et al. |
| 2019/0330284 A1 | 10/2019 | Torres et al. |

FOREIGN PATENT DOCUMENTS

| | | |
|---|---|---|
| WO | 02/059148 A2 | 8/2002 |
| WO | 2006/135912 A2 | 12/2006 |
| WO | 2009/049351 A1 | 4/2009 |
| WO | 2010/027828 A2 | 3/2010 |
| WO | 2010/037041 A2 | 4/2010 |
| WO | 2010119343 A2 | 10/2010 |
| WO | 2012/177658 A2 | 12/2012 |
| WO | 2013/096948 A1 | 6/2013 |
| WO | 2013/165613 A1 | 11/2013 |
| WO | 2015/089073 A2 | 6/2015 |

OTHER PUBLICATIONS

PCT International Preliminary Report on Patentability for PCT/US2016/035931 (dated Dec. 14, 2017).
Reyes-Robles et al., "Exploiting Dominant-Negative Toxins to Combat *Staphylococcus aureus* Pathogenesis," EMBO Reports 17(3):428-440 (2016).
Badarau et al., "Structure-Function Analysis of Heterodimer Formation, Oligomerization, and Receptor Binding of the *Staphylococcus aureus* Bi-Component Toxin LukGH," J. Biol. Chem. 290(1):142-156 (2015).
Dumont et al., "Identification of a Crucial Residue Required for *Staphylococcus aureus* LukAB Cytotoxicity and Receptor Recognition," Infect. & Immun. 82:1268-1276 (2014).
Extended European Search Report for European Patent Application No. 16804614.2 (dated Dec. 6, 2018).
Gouaux et al, "Alpha-Hemolysin, Gamma-Hemolysin, and Leukocidin from *Staphylococcus Aureus*: Distant in Sequence but Similar in Structure," Protein Science 6:2631-2635 (1997).
Hazenbos et al., "Novel Staphylococcal Glycosyltransferases SdgA and SdgB Mediate Immunogenicity and Protection of Virulence-Associated Cell Wall Proteins," PLOS Pathogens 9(10):e1003653 (2013).
PCT International Search Report and Written Opinion corresponding to PCT/US2016/035931, dated Oct. 7, 2016.
Ventura et al., "Identification of a Novel*Staphylococcus aureus* Two-Component Leukotoxin Using Cell Surface Proteomics," PLoS ONE 5:e11634 (2010).

(Continued)

*Primary Examiner* — Brian Gangle
(74) *Attorney, Agent, or Firm* — Troutman Pepper Hamilton Sanders LLP (Rochester)

(57) ABSTRACT

The present disclosure is directed to staphylococcal leukotoxin and hemolysin binding molecules and fusion constructs. The present disclosure is further directed to methods of treating, preventing, and diagnosing staphylococcal infection in a subject using the binding molecules and fusion constructs described herein.

15 Claims, 53 Drawing Sheets

Specification includes a Sequence Listing.

(56) References Cited

OTHER PUBLICATIONS

Dumont et al., "Characterization of a New Cytotoxin That Contributes to Staphylococcus aureus Pathogenesis," Mol. Microbiol. 79(3):814-825 (2011).
Nariya et al., "The C-Terminal Region of the S Component of Staphylococcal Leukocidin is Essential for the Biological Activity of the Toxin," FEBS 329(1,2):219-222 (1993).

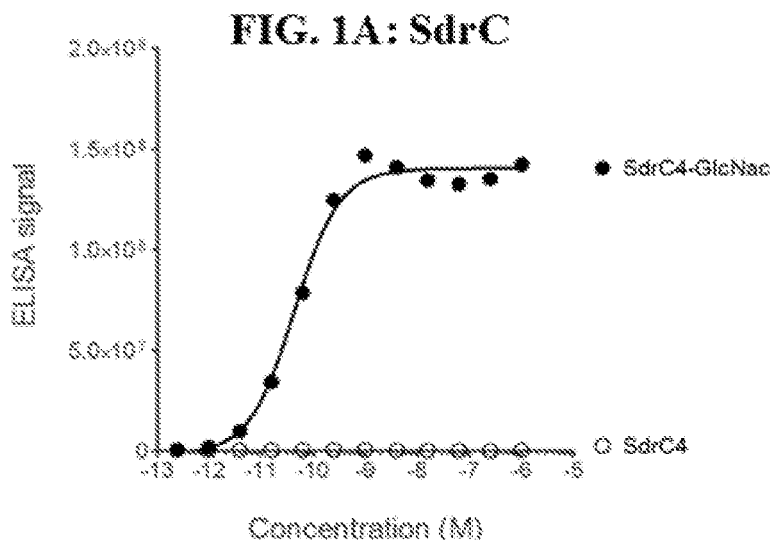
FIG. 1A: SdrC
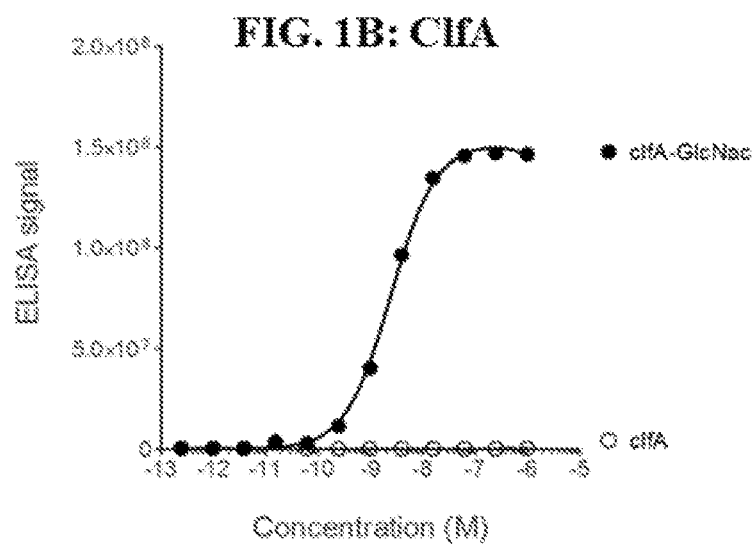
FIG. 1B: ClfA
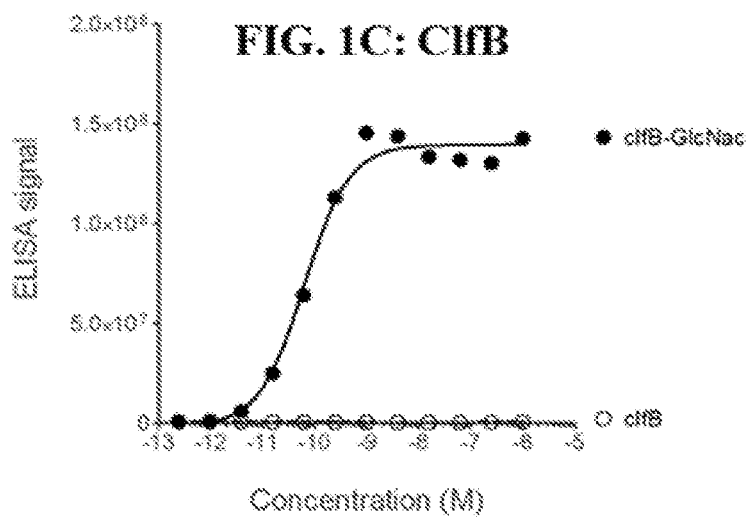
FIG. 1C: ClfB

FIG. 1D: SD Peptide
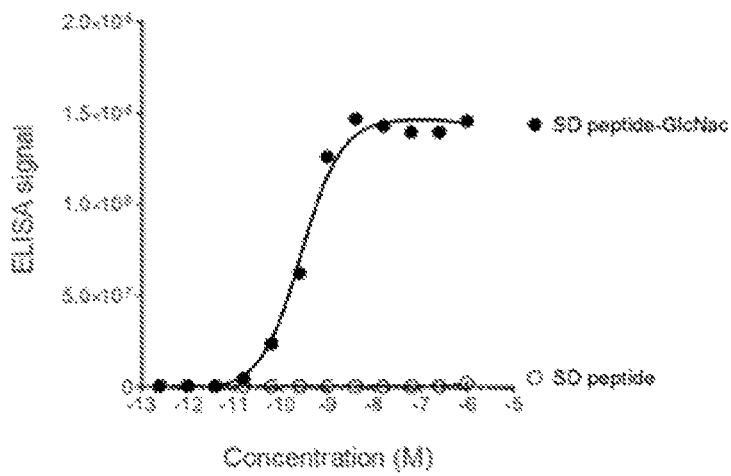
FIG. 1E: Anti-His Detection of SD Peptide
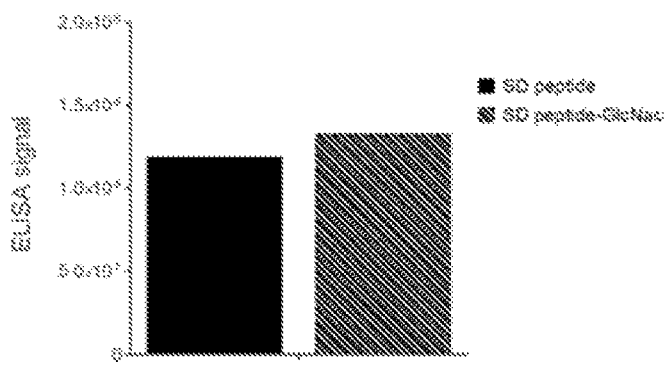
FIG. 1F: Binding of mAb 5133-FN3 Fusion Proteins
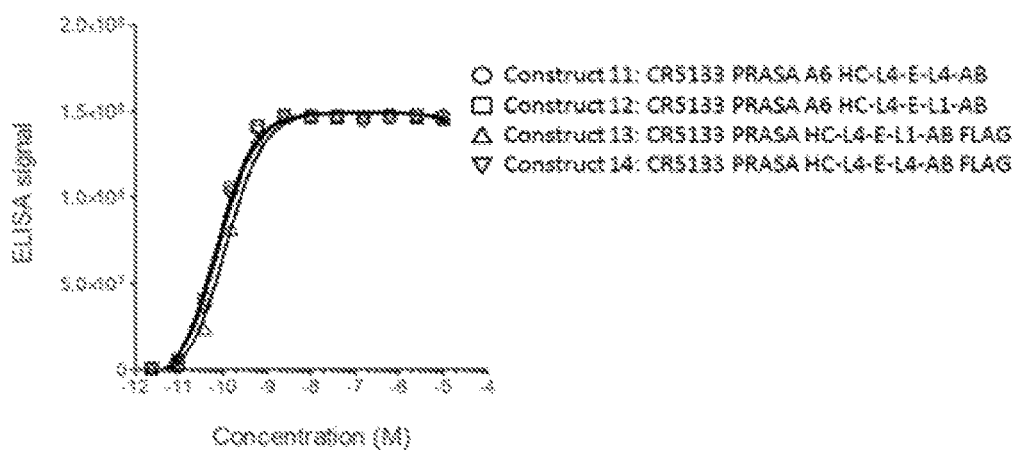

| Test article | Description | SdrCGlcNac | LukE | LukAB |
|---|---|---|---|---|
| Construct 4 | mAb 5133 PRASA A6 | 0.1 | 0 | 0 |
| Construct 6 | mAb5133 PRASA A6 HC-L4-AB | 0.1 | 0 | 1.8 |
| Construct 15 | mAb 5133 PRASA A6 HC-L4-E | 0.1 | 1.5 | 0 |
| Construct 11 | mAb5133 PRASA A6 HC-L4-E-L4-AB | 0.1 | 1.3 | 1.6 |

Figure 2B

| Test article | Description | Reactivity | K$_D$ (nM) SdrC-GlcNac | K$_D$ (nM) LukE | K$_D$ (nM) LukAB |
|---|---|---|---|---|---|
| Construct 4 | CR5133 PRASA A6 | SdrC4-GlcNac | 0.99 | no binding | no binding |
| Construct 6 | CR5133 PRASA A6 HC-L4-AB | SdrC4-GlcNac; LukAB | 0.91 | no binding | 0.07 |
| Construct 15 | CR5133 PRASA A6 HC-L4-E | SdrC4-GlcNac; LukE | 0.63 | 0.88 | no binding |
| Construct 11 | CR5133 PRASA A6 HC-L4-E-L4-AB | SdrC4-GlcNac; LukE; LukAB | 0.91 | 1.01 | 0.012 |

Figure 2C

Linker-1 length (N-terminal)

|   | 0 | 1 | 2 | 3 | 4 |
|---|---|---|---|---|---|
| 0 | -2.0 | - | - | - | - |
| 1 | - | -1.3 | -0.6 | -0.7 | -2.5 |
| 2 | - | -1.2 | -2.0 | 0.7 | -1.7 |
| 3 | - | -2.2 | -0.4 | -0.1 | -2.1 |
| 4 | - | -2.3 | -0.7 | 0.1 | -2.3 |

Linker-2 length (C-terminal)

$\Delta \log_{10}$ colony forming units

Figure 3B

Test Articles:
1: CNTO3930
2: mAb 5133 PRASA A6
3: mAb 5133 PRASA A6 HC-L4-E
4: mAb 5133 PRASA A6 HC-L4-E-L4-AB ● Abscess lesions on both kidneys
✕ Abscess lesions on one kidney
○ No abscess lesions on either kidney 1: CNTO3930
2: mAb 5133 PRASA A6
3: ProA3 PRASA A6 HC-L4-E-L4-AB
4: ProA9 PRASA A6 HC-L4-E-L4-AB
5: IsdB PRASA A6 HC-L4-E-L4-AB
6: mAb 6526 PRASA A6 HC-L4-E-L4-AB
7: RSV PRASA A6 HC-L4-E-L4-AB
8: mAb 5133 PRASA A6 HC-L4-E-L4-AB ● Abscess lesions on both kidneys
✗ Abscess lesions on one kidney
○ No abscess lesions on either kidney 1: CNTO3930
2: mAb 5133 PRASA A6
3: LTA PRASA A6 HC-L4-E-L4-AB
4: mAb 5133 PRASA A6 HC-L4-E-L4-AB ● Abscess lesions on both kidneys
✕ Abscess lesions on one kidney
○ No abscess lesions on either kidney 1: CNTO3930
2: CNTO3930 plus vancomycin
3: mAb5133
4: mAb5133 plus vancomycin
5: mAb5133 PRASA A6 HC-L4-E
6: mAb5133 PRASA A6 HC-L4-E plus vancomycin
7: mAb 5133 PRASA A6 HC-L4-E-L4-AB
8: mAb 5133 PRASA A6 HC-L4-E-L4-AB plus vancomycin ● Abscess lesions on both kidneys
✗ Abscess lesions on one kidney
○ No abscess lesions on either kidney 1: CNTO3930
2: mAb5133 PRASA A6
3: mAb5133 PRASA A6 HC-L4-E-L1-AB
4: mAb5133 PRASA HC-L4-E-L1-AB-FLAG
5: mAb5133 PRASA HC-L4-E-L4-AB-FLAG
6: mAb5133 PRASA A6 HC-L4-E-L4-AB 1: CNTO3930
2: mAb5133 PRASA A6
3: mAb5133 PRASA A6 HC-L4-AB
4: mAb5133 PRASA A6 HC-L4-E
5: mAb5133 PRASA A6 HC plus mAb5133 PRASA A6 HC-L4-AB
6: mAb5133 PRASA A6 HC-L4-E-L4-AB ● Abscess lesions on both kidneys
✕ Abscess lesions on one kidney
○ No abscess lesions on either kidney 1: CNTO3930
2: mAb5133 PRASA A6
3: mAb5133 PRASA A6 HC-L4-E-L1-AB
4: mAb5133 PRASA A6 HC-L4-E-L4-AB

| Test Article | 4hr pre-infection | 4hr post-infection |
|---|---|---|
| | Mean ΔCFU vs. CNTO3930 | Mean ΔCFU vs. CNTO3930 |
| 1 | (6.2) | (6.0) |
| 2 | -0.8 | -0.1 |
| 3 | -2.5 | -1.5 |
| 4 | -2.1 | -1.8 |

1: CNTO3930
2: mAb5133 PRASA A6
3: mAb5133 PRASA A6 HC-L4-E-L1-AB
4: mAb5133 PRASA A6 HC-L4-E-L4-AB

1: No Test Article
2: CNTO3930
2: mAb5133 PRASA A6
3: mAb5133 PRASA A6 HC-L4-E-L4-AB 1 & 6: RSV PRASA A6 HC-L4-wtTENCON
2 & 7: mAb5133 PRASA A6
3 & 8: mAb5133 PRASA A6 HC-L4-E
4 & 9: mAb5133 PRASA A6 HC-L4-E-L4-AB
5 & 10: mAb5133 PRASA A6 HC-L4-E-L4-AB

```
        10          20          30          40          50
NSAHHHHHHG  SNTN IEN IGD  GAEV IKRTED  VSSKKWGVTQ  NVQFDFVKDK 60          70          80          90         100
KYNKDAL I VK  MQGF INSRTS  FSDVKGSGYE  LTKRM IWPFQ  YN I GLTTKDP 110         120         130         140         150
NVSL I NYLPK  NK IETTDVGQ  TLGYN I GGNF  QSAPS IGGNG  SFNYSKT I SY 160         170         180         190         200
TQKSYVSEVD  KQNSKSVKWG  VKANEFVTPD  GKKSAHDRYL  FVQSPNGPTG 210         220         230         240         250
SAREYFAPDN  QLPPLVQSGF  NPSF I TTLSH  EKGSSDTSEF  ELSYGRNLD I 260         270         280         290
TYATLFPRTG  I YAERKHNAF  VNRNFVVRYK  VNWKTHE IKV  KGHN
```

Legend: No protection | Major protected LukE peptides | Minor protected LukE peptide

[Amino acid numbering per LukE sequence in SEQ ID NO: 1055]

Figure 20A

LukE regions identified by HDX mapping as interaction sites for the Luk26 FN3 protein:

$_{255}$LFPRTGIYAERKHNAFVNR$_{273}$ $_{25}$KGSGYEL$_{31}$

Figure 20B

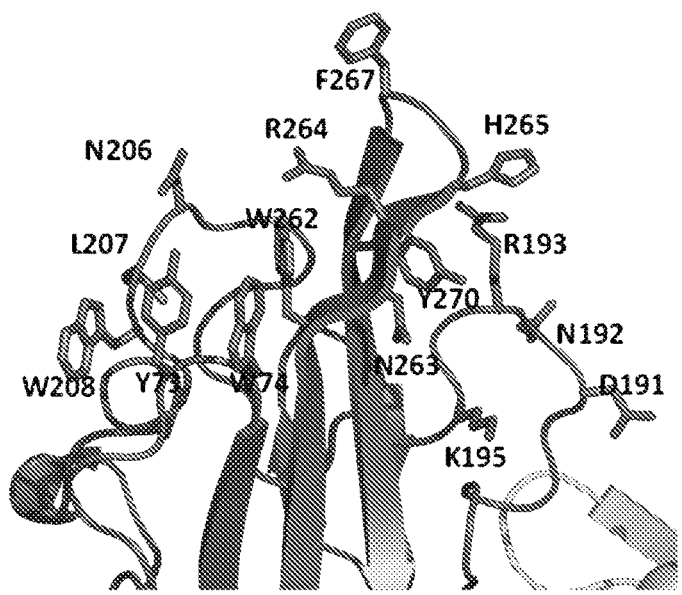 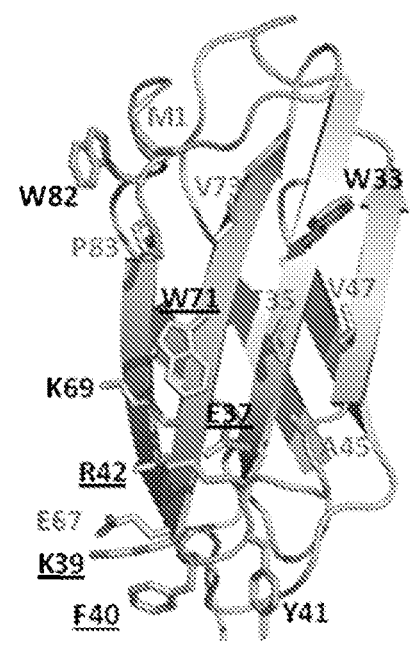
Figure 21D                    Figure 21E

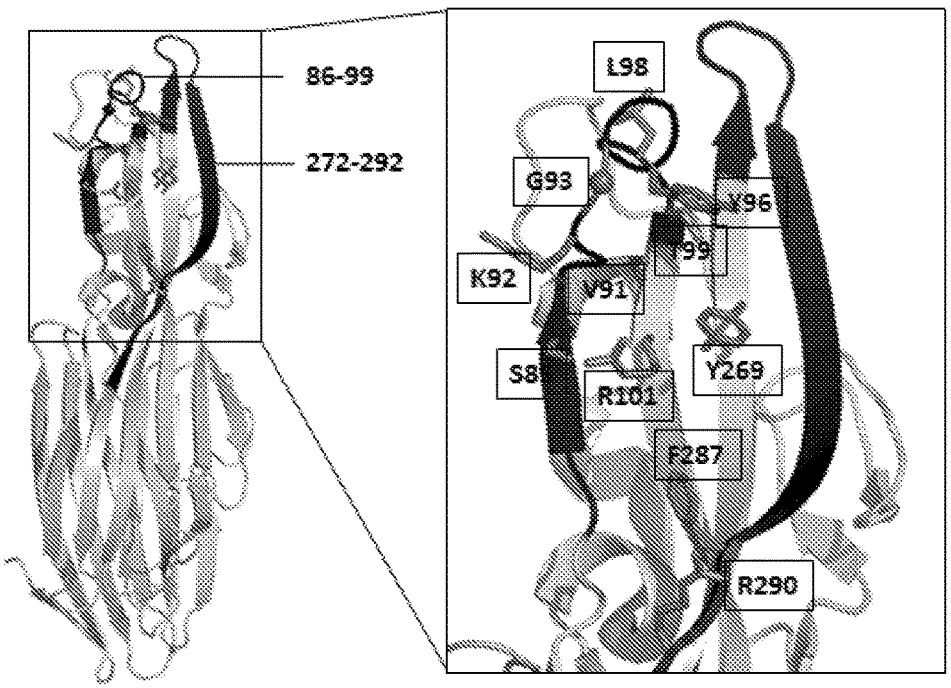

[Amino acid numbering per PDB entry 3ROH; SEQ ID No: 1054]

| LukE Binding/Neutralization Epitope Region 1 | | | | | | | | | | | | | | | | |
|---|---|---|---|---|---|---|---|---|---|---|---|---|---|---|---|---|
| Sequence ID# | Reference | \multicolumn{15}{c}{Residue Number} |
| | | T | S | F | S | D | V | K | G | S | G | Y | E | L | T | R |
| 1054 | PDB entry 3ROH | 86 | 87 | 88 | 89 | 90 | 91 | 92 | 93 | 94 | 95 | 96 | 97 | 98 | 99 | 101 |
| 1055 | HDX Mapping | 69 | 70 | 71 | 72 | 73 | 74 | 75 | 76 | 77 | 78 | 79 | 80 | 81 | 82 | 84 |
| 1056 | Mutant scan | 81 | 82 | 83 | 84 | 85 | 86 | 87 | 88 | 89 | 90 | 91 | 92 | 93 | 94 | 96 |

| LukE Binding/Neutralization Epitope Region 2 | | | | | | | | | | | | | | | | | | | | | |
|---|---|---|---|---|---|---|---|---|---|---|---|---|---|---|---|---|---|---|---|---|---|
| Sequence ID# | Reference | \multicolumn{20}{c}{Residue Number} |
| | | Y | L | F | P | R | T | G | I | Y | A | E | R | K | H | N | A | F | V | N | R | N | F |
| 1054 | PDB entry 3ROH | 269 | 272 | 273 | 274 | 275 | 276 | 277 | 278 | 279 | 280 | 281 | 282 | 283 | 284 | 285 | 286 | 287 | 288 | 289 | 290 | 291 | 292 |
| 1055 | HDX Mapping | 252 | 255 | 256 | 257 | 258 | 259 | 260 | 261 | 262 | 263 | 264 | 265 | 266 | 267 | 268 | 269 | 270 | 271 | 272 | 273 | 274 | 275 |
| 1056 | Mutant scan | 264 | 267 | 268 | 269 | 270 | 271 | 272 | 273 | 274 | 275 | 276 | 277 | 278 | 279 | 280 | 281 | 282 | 283 | 284 | 285 | 286 | 287 |

Figure 23C

>VH
EVQLVETGGGLVKPGGSLRLSCSASRFSFRDYYMTWIRQAPGKGPEWVSHISGSGST
IYYADSVRGRFTISRDNAKSSLYLQMDSLQADDTAVYYCARGGRATSYYWVHWGPGT
LVTVSS

>VL
EIVLTQSPATLSLSPGERATLSCRASQSVSGYLGWYQQKPGQAPRLLIYGASSRATG
IPDRFSGSGSGTDFTLTISRLEPEDFAVYYCQQYGSSPLTFGGGTKLEIK

COMPOSITIONS AND METHODS FOR ANTI-STAPHYLOCOCCAL BIOLOGIC AGENTS

This application is a national stage application under 35 U.S.C. § 371 of PCT Application No. PCT/US2016/035931, filed Jun. 4, 2016, which claims the benefit of U.S. Provisional Patent Application Ser. No. 62/171,788, filed Jun. 5, 2015, which is hereby incorporated by reference in its entirety.

FIELD OF THE INVENTION

The present invention is directed to staphylococcal leukotoxin binding molecules and fusion constructs. The present invention is further directed to methods of treating, preventing, and diagnosing staphylococcal infection in a subject using the binding molecules and fusion constructs described herein.

BACKGROUND

Bacterial infections caused by *Staphylococcus* bacteria (i.e., a "staph infection") are very common in the general population. About 25% of individuals commonly carry *Staphylococcus* bacteria on their skin or in their nose. Most of the time, these bacteria do not cause or problem or may cause a relatively minor skin infection. However, staph infections can turn deadly if the bacteria invade deeper into an individual's body, for example, entering the bloodstream, joints, bones, lungs or heart. In the past, a lethal staph infection might have occurred in a person who was hospitalized or had a chronic illness or weakened immune system. Now, it is increasingly common for an otherwise healthy individual to develop life-threatening staph infections. Importantly, many staph infections have become recalcitrant to antibiotic treatment due to infection with strains that exhibit true antibiotic resistance or reduced susceptibility to existing antibiotics. Such reductions in antibiotic effectiveness are typically more pronounced in patients with weakened immune systems due to immune senescence or immune compromization caused by co-morbidities or co-administered pharmaceutical agents or other medical procedures.

*Staphylococcus aureus*, often referred to as "staph," *Staph. aureus*," or "*S. aureus*," is a major human pathogen, producing a multitude of virulence factors making it able to cause several types of infection, from superficial lesions to toxinoses and life-threatening systemic conditions such as endocarditis, osteomyelitis, pneumonia, meningitis and sepsis (reviewed in Miller and Cho, "Immunity Against *Staphylococcus aureus* Cutaneous Infections," *Nat. Rev. Immunol.* 11:505-518 (2011)). Although most individuals encounter *S. aureus* shortly after birth (Holtfreter et al., "Towards the Immune Proteome of *Staphylococcus aureus*—The Anti-*S. aureus* Antibody Response," *Int. J. Med. Microbiol.* 300: 176-192 (2010)) and possess both antibodies against *S. aureus* and the ability to increase anti-*S. aureus* titers after infection, these antibodies are often not protective against recurrent *S. aureus* infections (Foster TJ, "Immune Evasion by Staphylococci," *Nat. Rev. Microbiol.* 3:948-958 (2005)). In the United States alone, an annual mortality of more than 20,000 is attributed to methicillin-resistant *S. aureus* (MRSA), exceeding deaths caused by influenza, viral hepatitis, and HIV/AIDS (Foster, TJ., "Immune Evasion by Staphylococci," *Nat. Rev. Microbiol.* 3:948-958 (2005); Klevens et al., "The Impact of Antimicrobial-Resistant, Health Care-Associated Infections on Mortality in the United States," *Clin. Infect. Dis.* 47:927-930 (2008)).

The pathogen produces a variety of molecules that presumably facilitate survival in or on the human host. Bi-component, pore-forming leukotoxins are among the secreted virulence factors produced by *S. aureus*. These toxins are secreted as water soluble monomers which oligomerize, and insert pores into the plasma membrane of host cells, most notably polymorphonuclear leukocytes (PMNs) and mononuclear phagocytes (Alonzo F. and Torres V., "*Staphylococcus aureus* Bi-component leukotoxins," *Microbiol. Mol. Biol. Rev.* 78(2): 199-230 (2014)). These pores disrupt cellular osmotic balance and membrane potential leading to death of the targeted cells. In the case of Leukotoxin ED (LukED), the targeting, binding, and killing of host phagocytic cells occurs via the cellular target CCR5, CXCR1 and CXCR2 located on the surface of the phagocytes (Alonzo III et al., "*Staphylococcus aureus* Leucocidin ED Contributes to Systemic Infection by Targeting Neutrophils and Promoting Bacterial Growth In Vivo," *Mol. Microbiol.* 83:423-435 (2012); Alonzo III et al. "CCR5 is a Receptor for *Staphylococcus aureus* Leukotoxin ED," *Nature* 493(7430)51-55 (2012); and Reyes-Robles et al., "*Staphylococcus aureus* Leukotoxin ED Targets the Chemokine Receptors CXCR1 and CXCR2 to Kill Leukocytes and Promote Infection," *Cell Host & Microbe* 14:453-459 (2013)). Indeed, when the cellular target of LukED, CCR5, is not present on host immune cells, the host animal is resistant to the otherwise lethal *S. aureus* infection (Alonzo III et al. "CCR5 is a Receptor for *Staphylococcus aureus* Leukotoxin ED," *Nature* 493(7430):51-55 (2012)). In recent studies, the Duffy antigen receptor for chemokines (DARC) was also identified as a receptor for LukED and is necessary for LukED-mediated hemolysis of erythrocytes (Spaan et al., "*Staphylococcus aureus* Targets the Duffy Antigen Receptor for Chemokines (DARC) to Lyse Erythrocytes," Cell Host & Microbe 18(3): p. 363-370 (2015)).

Leukotoxin AB (LukAB) can also kill host phagocytic cells, and its cytolytic activity can be exerted both from the outside and the inside of the cell, i.e., after the microorganism is phagocytosed into the host cell (Dumont et al., "*Staphylococcus aureus* LukAB Cytotoxin Kills Human Neutrophils by Targeting the CD11b Subunit of the Integrin Mac-1," *PNAS* 110(26):10794-10799 (2013)). Due to the contribution both of these leukotoxins have to pathogenesis, they have been considered critical *S. aureus* virulence factors (Alonzo III and Torres, "Bacterial Survival Amidst an Immune Onslaught: The Contribution of the *Staphylococcus aureus* Leukotoxins," *PLOS Path* 9(2):e1003143 (2013)).

Another critical factor for the pathogenic success of *S. aureus* depends on the properties of its surface proteins (Clarke et al., "Surface Adhesins of *Staphylococcus aureus*," *Adv. Microb. Physiol.* 51:187-224 (2006); Patti et al., "MSCRAMM-Mediated Adherence of Microorganisms to Host Tissues," *Annu. Rev. Microbiol.* 48:585-617 (1994); and Patti et al., "Microbial Adhesins Recognizing Extracellular Matrix Macromolecules," *Curr. Opin. Cell Biol.* 6:752-758 (1994)). *S. aureus* employs microbial surface components recognizing adhesive matrix molecules (MSCRAMMs) that adhere to and colonize host tissues via recognition of collagen, heparin-related polysaccharides, fibrinogen, and/or fibronectin of host cells. *S. aureus* expresses a subset of MSCRAMMs containing a serine-aspartate dipeptide repeat (SDR) domain, including clumping factor A (ClfA), clumping factor B (ClfB), SdrC, SdrD, and SdrE (Becherelli et al. "Protective Activity of the CnaBE3 Domain Conserved Among *Staphylococcus aureus*

Sdr Proteins," *PLoS One* 8(9): e74718 (2013)). *S. epidermidis* also expresses three members of this family, SdrF, SdrG, and SdrH (McCrea et al., "The Serine-Aspartate Repeat (Sdr) Protein Family in *Staphylococcus Epidermidis*," *Microbiology* 146:1535-1546 (2000)). These proteins share a similar structure comprising an N-terminal ligand-binding A domain followed by the SDR domain, which contains between 25-275 serine-aspartate dipeptide repeats. The C-terminal portion of these proteins contains the LPXTG-motif, which facilitates cell wall anchoring by the transpeptidase sortase A. The serine-aspartate dipeptide regions in these proteins are modified by the sequential addition of glycans by two glycosyltransferases. First, SdgB appends N-acetylglucosamine (GlcNAc) on serine residues within the serine-aspartate dipeptide regions, followed by SdgA modification of the glycoprotein, resulting in disaccharide moieties. This glycosylation protects SDR-containing staphylococcal proteins from Cathepsin G-mediated degradation (Hazenbos et al., "Novel Staphylococcal Glycosyltransferases SdgA and SdgB Mediate Immunogenicity and Protection of Virulence-Associated Cell Wall Proteins," *PLoS Pathog* 9(10):e1003653 (2013)).

Protein A, located on the surface of *S. aureus*, also contributes to staphylococcal escape from protective host immune responses by capturing the Fc domain of host IgG, as well as the Fab domain of the VH3 clan of IgG and IgM (Sjodahl et al., "Repetitive Sequences in Protein A from *Staphylococcus aureus*. Arrangement of Five Regions Within the Protein, Four Being Highly Homologous and Fc-Binding," *Eur. J. Biochem*. 73:343-351 (1997); and Cary et al., "The Murine Clan V(H) III Related 7183, J606 and S107 and DNA4 Families Commonly Encode for Binding to a Bacterial B cell Superantigen," *Mol. Immunol*. 36:769-776 (1999)). In addition, *S. aureus* expresses a second immunoglobulin binding protein referred to as the second binding protein for immunoglobulins (Sbi) (Zhang et al., "A Second IgG-Binding Protein in *Staphylococcus aureus*," *Microbiology* 144:985-991 (1998) and Atkins et al., "*S. aureus* IgG-binding Proteins SpA and Sbi: Host Specificity and mechanisms of Immune Complex Formation," *Mol. Immunol*. 45:1600-1611 (2008)). Sbi is either secreted or associated with the cell envelope (Smith et al., "The Sbi Protein is a Multifunctional Immune Evasion Factor of *Staphylococcus aureus*" *Infection & Immunity* 79:3801-3809 (2011) and Smith et al., "The Immune Evasion Protein Sbi of *Staphylococcus aureus* Occurs both Extracellularly and Anchored to the Cell Envelope by Binding to Lipotechoic Acid" *Mol. Microbiol*. 83:789-804 (2012)) and shares a pair of conserved helices with Protein A involved in binding to the Fc region of IgG proteins (Atkins et al., "*S. aureus* IgG-binding Proteins SpA and Sbi: Host Specificity and mechanisms of Immune Complex Formation," *Mol. Immunol*. 45:1600-1611 (2008)). Binding of IgGs to these proteins via the CH3 region of the Fc is thought to sequester antibodies on the cell surface of *S. aureus* in an orientation that prevents effective Fc-mediated opsonization of bacteria by neutrophils and therein serve as key immune evasion factors.

*S. aureus* also secretes a number of proteases that have been implicated in immune evasion. Rooijakkers et al. demonstrated that *S. aureus* secretion of staphylokinase, a plasminogen activator protein, led to the activation of plasmin that cleaved both surface-bound IgG and complement C3b, ultimately reducing immune-mediated *S. aureus* destruction (Rooijakkers et al., "Anti-Opsonic Properties of Staphylokinase," *Microbes and Infection* 7:476-484 (2005)). *S. aureus* also secretes the serine protease glutamyl endopeptidase V8 (GluV8) that can directly cleave human IgG1 in the lower hinge region between E233 and L234 (EU numbering (Edelman et al., "The Covalent Structure of an Entire GammaG Immunoglobulin Molecule," *PNAS* 63:78-85 (1969), Brezski et al., "Human Anti-IgG1 Hinge Autoantibodies Reconstitute the Effector Functions of Proteolytically Inactivated IgGs," *J. Immunol*. 181:3183-3192 (2008)). It was also recently demonstrated that human anti-*S. aureus* IgGs are rapidly cleaved when bound to the surface of *S. aureus* (Fernandez Falcon et al., "Protease Inhibitors Decrease IgG Shedding From *Staphylococcus aureus*, Increasing Complement Activation and Phagocytosis Efficiency," *J. Med. Microbiol*. 60:1415-1422 (2011)).

Taken together, these studies indicate that *S. aureus* utilizes a number of mechanisms that could adversely affect standard IgG1-based monoclonal antibody (mAb) therapeutics, either by directly cleaving the mAb, sequestering of the mAb by Protein A or Sbi binding on the *Staph* cell surface, or by killing off the very effector cells required for therapeutic efficacy. It is therefore not surprising that presently there are no mAb-based therapies targeting *S. aureus* that have achieved final approval for use in humans. Thus, there remains a need for methods and compositions that can treat staphylococcal infection, which (i) evade protein A and Sbi binding, (ii) escape staph-induced proteolysis, (iii) can neutralize leukotoxins and (iv) are capable of opsonizing and delivering *S. aureus* to phagocytes. The present application meets these and other needs.

SUMMARY

A first aspect of the present disclosure is directed to a binding molecule comprising one or more modified fibronectin type III (FN3) domains, each modified FN3 domain having one or more loop regions that comprise one or more staphylococcal leukotoxin binding regions.

Another aspect of the present disclosure is directed to a binding molecule comprising one or more modified fibronectin type III (FN3) domains, each modified FN3 domain having one or more loop regions that comprise one or more staphylococcal hemolysin binding regions.

A second aspect of the present disclosure is directed to a fusion construct. The fusion construct comprises a first portion comprising one or more binding molecules described herein, and a second portion coupled to said first portion. The second portion of the fusion construct comprises a second binding molecule, a pharmaceutically active moiety, a prodrug, a pharmaceutically-acceptable carrier, a diagnostic moiety, a cell penetrating enhancer moiety, and/or a half-life extending modulating moiety.

Another aspect of the present disclosure is directed to a pharmaceutical composition comprising the binding molecules and/or fusion constructs as described herein.

Other aspects of the present disclosure are directed to methods of treating, preventing, and diagnosing a staphylococcal infection in a subject using the binding molecules, fusion constructs, and/or pharmaceutical compositions described herein.

Another aspect of the present disclosure is directed to a recombinant Leukocidin B (LukB) polypeptide comprising an amino acid sequence corresponding to amino acid residues 1-109 of SEQ ID NO: 1026 coupled to amino acid residues 152-305 of SEQ ID NO: 1026, where the LukB polypeptide does not comprise one or more amino acid residues corresponding to amino acid residues 110-151 of SEQ ID NO: 1026.

Another aspect of the present disclosure is directed to a recombinant Leukocidin A (LukA) polypeptide comprising an amino acid sequence corresponding to amino acid residues 1-134 of SEQ ID NO: 1018 coupled to amino acid residues 175-324 of SEQ ID NO: 1018, where the LukA polypeptide does not comprise one or more amino acid residues corresponding to amino acid residues 135-174 of SEQ ID NO: 1018.

Another aspect of the present disclosure is directed to a vaccine composition. The vaccine composition comprises a recombinant Leukocidin B (LukB) polypeptide comprising an amino acid sequence corresponding to amino acid residues 1-109 of SEQ ID NO: 1026 coupled to amino acid residues 152-305 of SEQ ID NO: 1026, wherein said LukB polypeptide does not comprise one or more amino acid residues corresponding to amino acid residues 110-151 of SEQ ID NO: 1026. The vaccine composition further comprises a recombinant Leukocidin A (LukA) polypeptide comprising an amino acid sequence corresponding to amino acid residues 1-134 of SEQ ID NO: 1018 coupled to amino acid residues 177-324 of SEQ ID NO: 1018, wherein said LukA polypeptide does not comprise one or more amino acid residues corresponding to amino acid residues 135-174 of SEQ ID NO: 1018.

The staphylococcal leukotoxin binding molecules described herein are small (about 10 kDa), simple, and highly stable single domain proteins that do not contain cysteine, disulfides or glycosylated residues. These molecules have excellent biophysical properties (e.g., greater than 100 mg/mL expression, greater than 170 mg/mL solubility, greater than 82° C. melting temperature, low predicted immunogenicity, and stable in serum for more than one month), and can be engineered for improved stability. Other advantages over conventional therapeutics include the ability to administer locally, orally, or a cross the blood-brain barrier, the ability to express in *E. coli* allowing for increased expression of protein as a function of resources versus mammalian cell expression, the ability to be engineered into bispecific molecules that bind to multiple targets or multiple epitopes of the same target, the ability to be conjugated to drugs, polymers, and probes, the ability to be formulated to high concentrations, and the ability of such molecules to effectively penetrate diseased tissues. Accordingly, the binding molecules described herein comprising one or more staphylococcal leukotoxin binding domains offer a unique therapeutic, prophylactic, and diagnostic approach to combatting staphylococcal infection.

BRIEF DESCRIPTION OF THE DRAWINGS

FIGS. 1A-1F define a minimal epitope target for mAb 5133 and mAb 5133-FN3 fusion proteins. FIGS. 1A, 1B, and 1C show specific binding of mAb 5133 to the SdgB glycosylated form of SdrC4, ClfA, and ClfB, respectively. FIG. 1D shows mAb5133 binding to glycosylated streptavidin-bound SD peptide in a concentration dependent manner. The graph of FIG. 1E serves as a control showing that equivalent amounts of the glycosylated and non-glycosylated forms of the SD peptide are bound to the streptavidin-coated plates. FIG. 1F shows the binding of a series of mAb5133 fusion proteins to the glycosylated SD peptide.

FIGS. 2A-2C depict target antigen engagement by mAb 5133 and mAb 5133-FN3 fusion proteins including simultaneous target engagement (FIG. 2A), target binding stoichiometry (FIG. 2B), and binding affinity (FIG. 2C).

FIGS. 3A-3D show that target engagement by mAb 5133-FN3 fusion proteins can be altered by the length of linker coupling the mAb and FN3 portions of the fusion proteins. FIG. 3A shows variation in LukAB and LukE binding affinity due to changes in linker length. FIG. 3B is a matrix showing linker length mediated variation in fusion construct efficacy in a mouse model of *S. aureus* kidney infection. FIGS. 3C and 3D show the linker length-mediated variation in in vivo fusion protein binding to LukE (FIG. 3C) and LukAB (FIG. 3D) as well as linker length mediated variation in potential therapeutic efficacy for LukE (FIG. 3C) and LukAB (FIG. 3D) as measured by the number of colony forming units in a mouse model of *S. aureus* kidney infection.

FIG. 17A is a graph showing cytolytic activity of non-cognate leukotoxins LukE/LukF-PV and LukE/HlgB against primary human neutrophils. The top and bottom graphs of FIG. 17B show the relative activity of CNTO3930 and two mAb5133-FN3 fusion proteins in protecting primary human neutrophils from LukE/LukF-PV mediated cytolysis, as determined by the percent cell death (top graph) and release of LDH (bottom graph). The top and bottom graphs of FIG. 17C show the relative activity of CNTO3930 and two mAb5133-FN3 fusion proteins in protecting primary human neutrophils from LukE/HlgB mediated cytolysis, as determined by percent cell death (top graph) and the release of LDH (bottom graph).

FIG. 18A shows a dose-dependent decrease in LukED mediated hemolysis with mAb5133-FN3 fusion protein treatment. The data is shown as percent hemolysis observed as compared to the 100% value observed with Triton X-100. FIG. 18B shows a dose-dependent decrease in LukED mediated hemolysis observed with mAb5133-FN3 fusion protein treatment. In this graph, the data is shown as percent hemolysis observed as compared to the 100% value observed with LukED treatment alone.

FIG. 19A is a differential heat map of LukB (SEQ ID NO: 11) resulting from HDX mapping in the presence or absence of the Luk17 FN3 protein. The LukB peptide regions, $_{260}$IDWNRHGFWG$_{269}$ (amino acid residues 260-269 of SEQ ID NO: 11) and $_{201}$LTRNGNLWAKDNFTPKDKMPVTVS$_{224}$ (amino acid residues 201-224 of SEQ ID NO: 11), identified in the map as Protected LukB peptide #1 and Protected LukB peptide #2, respectfully, contain residues of a LukAB neutralizing epitope bound by Luk17 FN3. FIG. 19B shows the localization of these linear sequences on a published, three-dimensional structure of LukAB as determined by X-ray crystallography (PDB entry 4tw1).

FIGS. 20A-20B depict the identification of potential neutralization epitopes on leukocidin LukE by solution phase hydrogen/deuterium exchange (HDX)-Mass Spectrometry (MS). FIG. 20A is a differential heat map of LukE (SEQ ID NO: 1055) resulting from HDX mapping in the presence of absence of Luk26 FN3). The LukE peptide regions, $_{69}$TSFSDVKGSGYELT$_{82}$ (amino acid residues 69-82 of SEQ ID NO: 1055) and $_{255}$LFPRTGIYAERKHNAFVNRNF$_{275}$ (amino acid residues 255-275 of SEQ ID NO: 1055), and $_{244}$YGRN$_{247}$ (amino acid residues 244-247 of SEQ ID NO: 1055) identified in the map as Major protected LukE peptides and Minor protected LukE peptides, respectively, contain residue of a LukE neutralizing epitope that is bound by Luk26 FN3. FIG. 20B shows the localization of these linear sequences on a published, three-dimensional structure of LukE as determined by X-ray crystallography.

FIGS. 21A-21F depict the characterization of the neutralization epitope of the Luk17 FN3 protein on LukAB by x-ray crystallography. FIG. 21A shows the overall structure of the LukAB/S17/214F ternary complex as determined by X-ray crystallography. In this Figure LukA is shown in dark gray, LukB is shown in white, Fab214 is shown in light gray, and S17 is shown in black. FIG. 21B shows the alternate conformation of the pore-forming segments of LukA and LukB as determined for octameric and heterodimeric X-ray structures of LukAB. The left-hand portion of this figure is a structure overlay of LukB (white). The two A and B segments are colored black and dark gray in the dimer and octamer structures. The switch points for the two different conformations are identical. FIG. 21C shows the relative location of the Luk17 FN3 (S17) protein and Fab 214F binding sites on LukAB with respect to the membrane spanning segment in the LukAB octameric form. Shown is a structure of a composite of the LukAB/S17/214F structure and the LukAB octameric structure (PDB ID 4tw1). Binding of S17 and 214F is compatible with both dimer and octamer. The switching segments (dark gray) in the octamer form the inner pore whereas both S17 and 214F bind the exterior of the octamer. FIG. 21D shows minimal components of the LukAB neutralization epitope for the Luk17 FN3 protein as determined from the structure of the LukAB/S17/214F ternary complex, and the corresponding paratope of the Luk17 FN3 protein is shown in FIG. 21E. Black underlined labels indicate residues for which mutations have most impact upon binding and the other black labels indicate residues with intermediate effects. Some epitope residues were not mutated or had minimal effect (gray label). FIG. 21F shows representational electron density at the LukB epitope/Luk17 FN3 paratope interface. The white labels in this Figure depict the S17 paratope residues while the black labels depict the LukB epitope residues.

FIG. 22A shows the calculated affinity constant ($K_D$) and values for the Luk17 FN3 protein as determined by Bio-Layer Interferometry (BLI) for a series of site-directed substitution mutant variants of LukB. The amino acid number is per PDB ID#4tw1 (SEQ ID NO: 1026). FIG. 22B shows the calculated dissociation constant ($K_{dis}$) values for the Luk17 FN3 protein as determined by BLI for the same series of LukB variants. The amino acid number is per the sequence of PDB entry4tw1 (SEQ ID NO: 1026).

FIGS. 23A-23C depict the mutational mapping of LukE to confirm the neutralization epitope of the Luk26 FN3 protein. FIG. 23A shows the calculated affinity constant ($K_D$) and values for the Luk26 FN3 protein as determined by BLI for a series of site-directed substitution mutant variants of LukE. The amino acid number is per PDB ID#3ROH (SEQ ID NO: 1054). FIG. 23B shows the calculated dissociation constant ($K_{dis}$) values for the Luk26 FN3 protein as determined by BLI for the same series of LukE variants. The amino acid number is per PDB ID#3ROH (SEQ ID NO: 1054). FIG. 23C shows the localization of residues that contribute to the LukED neutralization epitope for the Luk26 FN3 protein mapped on to the three-dimensional surface of a published high-resolution crystal structure of LukE. The amino acid number is per the sequence of PDB entry3ROH (SEQ ID NO: 1054). For clarity, an alignment of the LukED neutralization epitope regions within the recombinant LukE sequence used in the HDX mapping (Example 20; SEQ ID No: 1055), the recombinant LukE sequence used in the mutational analysis (Example 23; SEQ ID No: 1056), and the sequence of published LukE structure (PDB entry 3ROH; SEQ ID NO: 1054) is shown in FIG. 23C. Note that the numbering of the SEQ ID NO: 1054 is based on Thr$^{30}$ being identified as the first residue for which electron density is apparent in the published LukE crystal structure (Nocadello et al., "Crystal structures of the components of the *Staphylococcus aureus* leukotoxin ED" *Acta. Cryst. D*72: 113-120 (2016), which is hereby incorporated by reference in its entirety; PDB entry 3roh).

FIG. 24A shows the binding of mAb 5133 to a series of synthetic serine-aspartate (SD) repeat peptides with variable glycosylation characteristics as determined in an ELISA format assay. FIG. 24B shows a ribbon format structure of the complex of SM1B229 and GlcNAc. The SM1B229 heavy chain is shown in gray, the light chain is shown in white, and GlcNac is shown in black. Hydrogen bonding interactions are shown as dashed lines. FIG. 24C shows the electrostatic surface potential of the structure of the complex of SM1B229 and GlcNAc. The positive electrostatic surface potential shaded darker, and negative electrostatic surface potential shaded lighter. GlcNac is shown in white. The variable heavy (VH) region (amino acid residues 1-120 of SEQ ID NO: 1082) and variable light (VL) region (amino acid residues 1-107 of SEQ ID NO: 1083) of the SM1B229 are depicted beneath the structure. The underlined regions are the CDRs of each chain. CDR3 of the VH region (bold and underlined) forms a basic pocket for GlcNac binding.

FIG. 26A shows the binding of a toxoid LukAB to Luk17-His-SA (SEQ ID NO: 1153) and TENCON-His-SA (SEQ ID NO: 1152) FN3 binding domain proteins as determined by Bio-Layer Interferometry (BLI). FIG. 26B shows the binding of the LukAB$^{mut1}$ stem domain mutant variant to Luk17-His-SA and TENCON-His-SA FN3 binding domain proteins as determined by BLI. FIG. 26C shows the binding of the LukAB$^{mut2}$ stem domain mutant variant to Luk17-His-SA and TENCON-His-SA FN3 binding domain proteins as determined by BLI. FIG. 26D shows the binding of the LukAB$^{mut3}$ stem domain mutant variant to Luk17-His-SA and TENCON-His-SA FN3 binding domain proteins as determined by BLI.

FIG. 27A shows western blot analysis of the relative levels of FN3 domain proteins detected in sera from mice at two and twenty four hours after test article administration. No parental FN3 domain proteins are detected at either time point. In contrast, FN3 domain fusion proteins that exhibit an extended serum residence time (and therein exposure) are detected as full length proteins both two and twenty four hours after test article administration. FIG. 27B shows the relative protection observed with a series of FN3 domain proteins following administration of a lethal dose of LukED toxin to mice. Four hours post dosing, 100% protection is observed for the SAFN3-LukE26 fusion protein that bears an amino-terminal FN3 domain protein that binds serum albumin and a carboxyl terminal FN3 domain protein that binds LukED and neutralizes its cytolytic activity. FIG. 27C shows that this 100% protection is conserved on re-challenge of the SAFN3-LukE26 dosed animals 4.5 hours after the initial lethal intoxication challenge with LukED. FIG. 27D shows the relative protection observed with a series of FN3 domain proteins following administration of a lethal dose of LukED toxin to mice. Four hours post dosing, 100% protection is observed for the SABD-LukE26 fusion protein that bears an amino-terminal serum albumin binding domain and a carboxyl terminal FN3 domain protein that binds LukED and neutralizes its cytolytic activity. FIG. 27E shows that this 100% protection is conserved on re-challenge of the SABD-LukE26 dosed animals 4.5 hours after the initial lethal intoxication challenge with LukED. FIG. 27F shows the relative protection observed with a series of FN3 domain proteins following administration of a lethal dose of LukED toxin to mice. Four hours post dosing, 100% protection is observed for the TFFN3-LukE26 fusion protein that bears an amino-terminal FN3 domain protein that binds transferrin and a carboxyl terminal FN3 domain protein that binds LukED and neutralizes its cytolytic activity. FIGS. 27G and 27H show the relative activity of a series of FN3 domain proteins in neutralizing the ex vivo cytolytic activity of LukED against freshly prepared human PMNs as measure by LDH release (FIG. 27G) and cell death (FIG. 27H). As expected, neutralization of the cytolytic activity of LukED is observed with all FN3 domain proteins that contain the LukE26 entity. Finally, FIG. 27I shows the extent of protection of mice following administration of sequential lethal doses of the LukED leukocidin 5, 24 and 48 hours post dosing of SABD-Luk26 at a 1×, 10× and 100× molar ratio of SABD-Luk26 over LukED.

DETAILED DESCRIPTION

Figure 2A:
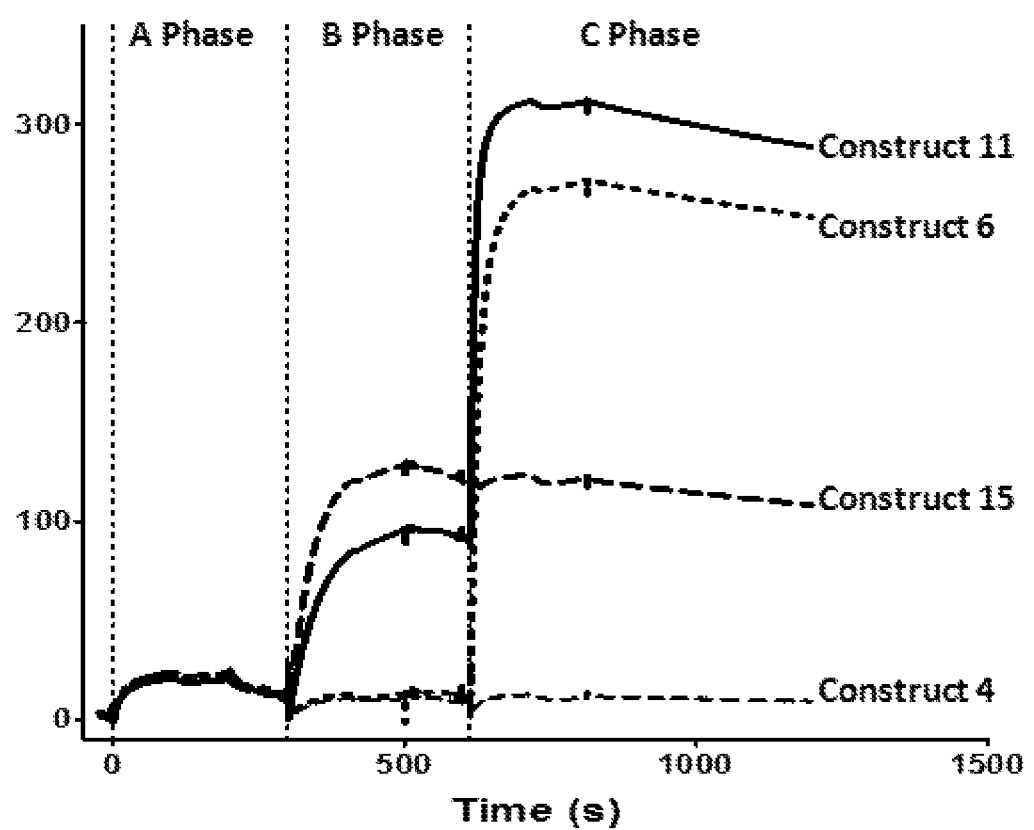

A first aspect of the present disclosure is directed to a binding molecule comprising one or more modified fibronectin type III (FN3) domains, where each modified FN3 domain has one or more loop regions that comprise one or more staphylococcal leukotoxin binding regions.

The FN3 domain is an evolutionary conserved protein domain that is about 100 amino acids in length and possesses a beta sandwich structure. The beta sandwich structure of human FN3 comprises seven beta-strands, referred to as strands A, B, C, D, E, F, G, with six connecting loops, referred to as loops AB, BC, CD, DE, EF, and FG that exhibit structural homology to immunoglobulin binding domains. Three of the six loops, i.e., loops DE, BC, and FG, correspond topologically to the complementarity determining regions of an antibody, i.e., CDR1, CDR2, and CDR3. The remaining three loops are surface exposed in a manner similar to antibody CDR3. In accordance with the present disclosure, one or more of the loop regions of each FN3 domain of the binding molecule are modified to comprise one or more staphylococcal leukotoxin binding regions.

The modified FN3 domain of the binding molecule of the present disclosure can be a FN3 domain derived from any of the wide variety of animal, yeast, plant, and bacterial extracellular proteins containing these domains. In one embodiment, the FN3 domain is derived from a mammalian FN3 domain. Exemplary FN3 domains include, for example and without limitation, any one of the 15 different FN3 domains present in human tenascin C, or the 15 different FN3 domains present in human fibronectin (FN) (e.g., the 10$^{th}$ fibronectin type III domain). Exemplary FN3 domains also include non-natural synthetic FN3 domains, such as those described in U.S. Pat. Publ. No. 2010/0216708 to Jacobs et al., which is hereby incorporated by reference in its entirety. Individual FN3 domains are referred to by domain number and protein name, e.g., the $3^{rd}$ FN3 domain of tenascin (TN3), or the $10^{th}$ FN3 domain of fibronectin (FN10).

In one embodiment, the FN3 domain of the binding molecule is derived from the non-naturally occurring FN3 domain of Tencon (SEQ ID NO: 1017). Tencon was designed from a consensus sequence of fifteen FN3 domains from human tenascin-C (Jacobs et al., "Design of Novel FN3 Domains With High Stability by a Consensus Sequence Approach," *Protein Engineering, Design, and Selection* 25:107-117 (2012), the disclosure of which is hereby incorporated by reference in its entirety). In another embodiment, the FN3 domain of the binding molecule is derived from the non-naturally occurring FN3 domain of Tencon-25 (SEQ ID NO: 1) as disclosed in Diem et al., "Selection of high-affinity Centyrin FN3 domains from a simple library diversified at a combination of strand and loop positions," *Protein Engineering, Design, and Selection* 10:419-429 (2014), which is hereby incorporated by reference in its entirety).

Tencon domains, like other FN3 domains, have a beta-sandwich structure with the seven beta-strands, i.e., A, B, C, D, E, F, and G, linked by six loops, i.e., AB, BC, CD, DE, EF, and FG loops (Bork and Doolittle, *Proc. Natl. Acad. Sci. USA* 89:8990-8992 (1992) and U.S. Pat. No. 6,673,901 to Koide et al., which are hereby incorporated by reference in their entirety). These loops span at or about amino acid residues 13-16 of SEQ ID NO: 1 (AB loop), amino acid residues 22-28 of SEQ ID NO: 1 (BC loop), amino acid residues 38-43 of SEQ ID NO:1 (CD loop), amino acid residues 51-54 of SEQ ID NO:1 (DE loop), amino acid residues 60-64 of SEQ ID NO: 1 (EF loop), and amino acid residues 75-81 of SEQ ID NO: 1 (FG loop). In accordance with the present disclosure, one or more of these loop regions or selected residues within one or more of these loop regions are modified for staphylococcal leukotoxin binding specificity and affinity. Suitable modifications include amino acid residue substitutions, insertions, and/or deletions. In one aspect, amino acid residues in at least one, at least two, at least three, at least four, at least five, or all six of the loop regions are altered for staphylococcal leukotoxin binding specificity and affinity. In one embodiment, one or more amino acid modifications within the loop regions at or about residues 22-28 (BC loop), 38-43 (CD loop), 51-54 (DE loop), and 75-81 (FG loop) of SEQ ID NO: 1 form the staphylococcal leukotoxin binding region. In another embodiment, one or more amino acid modification within the loop regions at or about residues 38-43 (CD loop) and 75-81 (FG loop) form the staphylococcal leukotoxin binding region. The modified one or more loop regions preferably interact with their target staphylococcal leukotoxin protein similar to an antibody CDR interaction with the protein.

As discussed above, FN3 domains contain two sets of CDR-like loops on the opposite faces of the molecule. The two sets of loops are separated by beta-strands that form the center of the FN3 structure. Like the loops, these beta-strands can be altered to enhance target molecule binding specificity and affinity. Preferably, some or all of the surface exposed residues in the beta strands are randomized without affecting (or minimally affecting) the inherent stability of the FN3 domain. One or more of the beta-strands can interact with a target protein. The beta-strands in a FN3 binding molecule provide a flat binding surface (compared to a curved binding surface found in protein scaffolds containing adjacent loops) that affects the target proteins, or specific epitopes on those target proteins, that can be bound effectively by the domain. In one aspect, at least a portion of one or more beta-strands of the FN3 domain is modified to interact with a staphylococcal leukotoxin protein. Suitable modifications include amino acid substitutions, insertions, and/or deletions. For example, one or more amino acid residues of the A beta strand (i.e., amino acid residues corresponding to residues 1-12 of SEQ ID NO: 1), the B beta strand (i.e., amino acid residues corresponding to residues 17-21 of SEQ ID NO: 1), the C beta strand (i.e., amino acid residues corresponding to residues 29-37 of SEQ ID NO: 1), the D beta strand (i.e., amino acid residues corresponding to residues 44-50 of SEQ ID NO: 1), the E beta strand (i.e., amino acid residues corresponding to residues 55-59 of SEQ ID NO: 1), the F beta strand (i.e., amino acid residues corresponding to residues 65-74 of SEQ ID NO: 1), or the G beta strand (i.e., amino acid residues corresponding to residues 82-89 of SEQ ID NO: 1) may be modified to generate staphylococcal leukotoxin binding domains or to enhance the specificity or affinity of leukotoxin binding. In one embodiment, one or more amino acid residues of the C beta strand and/or the F beta strand are modified for binding to a staphylococcal leukotoxin protein.

In one embodiment, the binding molecules of the present disclosure specifically bind to one or more staphylococcal leukotoxins, also referred to herein as staphylococcal leukocidins. Staphylococcal leukotoxins are a family bi-component toxins released by *S. aureus*, which damage membranes of host defense cells and erythrocytes by the synergistic action of two non-associated proteins or subunits, i.e., the S-subunit and F-subunit (see Menestrina et al., "Mode of Action of Beta-Barrel Pore-Forming Toxins of the Staphylococcal Alpha-Hemolysin Family," *Toxicol.* 39(11): 1661-1672 (2001). The binding molecules as described herein bind to one or more staphylococcal leukotoxins selected from leukotoxin A (LukA), leukotoxin B (LukB), leukotoxin AB (LukAB), leukotoxin D (LukD), leukotoxin E (LukE), leukotoxin ED (LukED), Panton-Valentine leukocidin S (LukS-PV), Panton-Valentine leukocidin F (LukF-PV), Panton-Valentine leukocidin (LukSF/PVL), gamma hemolysin A (HlgA), gamma hemolysin C (HlgC), gamma hemolysin B (HlgB), gamma hemolysin AB (HlgAB), and gamma-hemolysin BC (HlgBC). In one embodiment, the binding molecule binds to one or more of the staphylococcal leukotoxins selected from LukAB, LukD or LukE. In another embodiment, the binding molecules hereof are capable of specifically binding to a fragment of the above-mentioned proteins, where the fragment at least comprises a neutralizing epitope of the leukotoxin protein. Binding of the binding molecule of the present disclosure to a neutralizing epitope of the leukotoxin protein substantially or completely eliminates leukotoxin cytolytic and/or hemolytic activity. Neutralizing epitopes generally include regions of the leukotoxin protein involved in binding to a host cell membrane or receptor, regions of the leukotoxin protein involved in interacting with other leukotoxin proteins and oligomer formation, and regions of the leukotoxin protein involved in pore formation. The binding molecules of the present disclosure neutralize leukotoxin activity by at least 30%, 35%, 40%, 45%, 50%, 55%, 60%, 65%, 70%, 75%, 80%, 85%, 90%, 91%, 92%, 93%, 94%, 95%, 96%, 96%, 98%, 99%, or 100% when compared to leukotoxin activity in the absence of the binding molecule.

As used herein "specifically binds" or "specific binding" refers to the ability of the FN3 containing binding molecule of the disclosure to bind to a predetermined antigen, i.e., a staphylococcal leukotoxin with a dissociation constant ($K_D$) of about $1\times10^{-6}$ M or less, for example about $1\times10^{-7}$ M or less, about $1\times10^{-8}$ M or less, about $1\times10^{-9}$ M or less, about $1\times10^{-10}$ M or less, about $1\times10^{-11}$ M or less, about $1\times10^{-12}$ M or less, or about $1\times10^{-13}$ M or less. Typically the leukotoxin binding FN3 domain binds to its target leukotoxin(s) with a $K_D$ that is at least ten fold less than its $K_D$ for a nonspecific antigen (for example BSA or casein) as measured by surface plasmon resonance using for example a Proteon Instrument (BioRad). Thus, a monospecific, bispecific, or multispecific leukotoxin FN3 domain containing molecule as described herein specifically binds to each target leukotoxin with a binding affinity ($K_D$) of at least $1\times10^{-6}$ M or less. The isolated modified FN3 domain of the disclosure that specifically binds to a staphylococcal leukotoxin may, however, have cross-reactivity to other related bi-component toxins, for example to related S-subunit or F-subunit leukotoxins.

In one aspect, the binding molecule comprises a modified FN3 domain having one or more loop regions that comprise one or more LukE binding regions. This binding molecule is capable of binding a staphylococcal LukE protein having the amino acid sequence of SEQ ID NO: 1055 or fragments or homologs thereof. The LukE protein exemplified by SEQ ID NO: 1055 corresponds to the native mature LukE protein sequence modified to contain an N-terminal histidine tag. Accordingly, the amino acid residue at position 12 of SEQ ID NO: 1055 corresponds to the first amino acid residue of the mature LukE protein.

In one embodiment, binding of the LukE binding molecule to LukE effectively neutralizes LukE cytolytic and/or hemolytic activity, e.g., by inhibiting LukE and LukD interaction, inhibiting LukE binding to the plasma membrane of leukocytes, and/or inhibiting LukED pore formation. In accordance with this embodiment, the LukE binding molecule binds to one or more epitopes of LukE within a region of LukE comprising or consisting of amino acid residues corresponding to residues 22-33 of SEQ ID NO: 1055 (residues involved in LukE-LukD protein interaction), amino acid residues corresponding to residues 123-128 of SEQ ID NO: 1055 (residues involved in LukED membrane penetration), or amino acid residues corresponding to residues 137-142 of SEQ ID NO: 1055 (residues involved in LukED membrane penetration). In another embodiment, the LukE binding molecule binds to one or more epitopes of LukE within a region of LukE involved in LukE cell targeting. These regions comprise amino acid residues corresponding to residues 68-86 of SEQ ID NO: 1055, amino acid residues corresponding to residues 151-161 of SEQ ID NO: 1055, amino acid residues corresponding to residues 175-189 of SEQ ID NO: 1055, amino acid residues corresponding to residues 193-207 of SEQ ID NO: 1055, and amino acid residues corresponding to residues 248-278 of SEQ ID NO: 1055. As demonstrated in the Examples herein, amino acid residues 69-84 of SEQ ID NO: 1055 (corresponding to amino acid residues 86-101 of SEQ ID NO: 1054), and amino acid residues 252-275 of SEQ ID NO: 1055 (corresponding to amino acid residues 269-292 of SEQ ID NO: 1054) contain neutralizing epitopes of LukE.

In one embodiment, a LukE binding molecule as described herein comprises a C strand and a CD loop region having the amino acid sequence
DSFX$_{32}$IX$_{34}$YX$_{36}$EX$_{38}$X$_{39}$X$_{40}$X$_{41}$X$_{42}$E (SEQ ID NO: 993), where
X$_{32}$ is any amino acid residue,
X$_{34}$ is E or a functionally equivalent amino acid residue,
X$_{36}$ is any amino acid residue,
X$_{38}$ is any amino acid residue,
X$_{39}$ is W or a functionally equivalent amino acid residue,
X$_{40}$ is any amino acid residue,
X$_{41}$ is W or a functionally equivalent amino acid residue,
X$_{42}$ is any amino acid residue;
and an F strand and FG loop region having the amino acid sequence of TX$_{66}$YX$_{68}$VX$_{70}$IX$_{72}$GVKG X$_{77}$ X$_{78}$ X$_{79}$ SX$_{81}$ (SEQ ID NO: 994), where
X$_{66}$ is any amino acid residue,
X$_{68}$ is any amino acid residue,
X$_{70}$ is F or a functionally equivalent amino acid residue,
X$_{72}$ is G or a functionally equivalent amino acid residue,
X$_{77}$ is any amino acid residue,
X$_{78}$ is any amino acid residue,
X$_{79}$ is any amino acid residue.
X$_{81}$ is any amino acid residue.

In one embodiment, the LukE binding molecule as described herein comprises the a C strand and a CD loop region of SEQ ID NO: 993 and the F strand and FG loop region of SEQ ID NO: 994 as described above and binds to a neutralizing epitope of LukE in one of the regions of LukE noted above, i.e., amino acid residues 22-33, 123-128, 137-142, 68-86, 151-161, 175-189, 193-207, and 248-278 of SEQ ID NO:1055.

In another embodiment, the LukE binding molecule as described herein comprises the amino acid sequence of LPAPKNLVVSRVTEDSARLSWTAPDAAFDSF X$_{32}$I X$_{34}$Y X$_{36}$E X$_{38}$ X$_{39}$ X$_{40}$ X$_{41}$ X$_{42}$EAI X$_{46}$LTVPGSERSYDLTGLKPGT X$_{66}$Y X$_{68}$V X$_{70}$I X$_{72}$GVKG X$_{77}$ X$_{78}$ X$_{79}$ S X$_{81}$ X$_{82}$L X$_{84}$A X$_{86}$FTT (SEQ ID NO: 989), where
X$_{32}$ is any amino acid residue,
X$_{34}$ is E or a functionally equivalent amino acid residue,
X$_{36}$ is any amino acid residue,
X$_{38}$ is any amino acid residue,
X$_{39}$ is W or a functionally equivalent amino acid residue,
X$_{40}$ is any amino acid residue,
X$_{41}$ is W or a functionally equivalent amino acid residue,
X$_{42}$ is any amino acid residue,
X$_{46}$ is any amino acid residue,
X$_{66}$ is any amino acid residue,
X$_{68}$ is any amino acid residue,
X$_{70}$ is F or a functionally equivalent amino acid residue,
X$_{72}$ is G or a functionally equivalent amino acid residue,
X$_{77}$ is any amino acid residue,
X$_{78}$ is any amino acid residue,
X$_{79}$ is any amino acid residue,
X$_{81}$ is any amino acid residue,
X$_{82}$ is any amino acid residue,
X$_{84}$ is any amino acid residue, and
X$_{86}$ is any amino acid residue.

In accordance with this aspect, exemplary LukE binding molecules comprise any one of the amino acid sequences of SEQ ID NOs: 25 (Luk26) and 739-814.

In some embodiments, these LukE binding molecules comprise an initiator methionine residue linked to the N-terminus or a cysteine residue linked to the C-terminus to facilitate expression and/or conjugation to another moiety (e.g., another leukotoxin binding FN3 domain, a half-life extending moiety, or other therapeutic moiety).

In another embodiment, the LukE binding molecule as described herein binds LukE with one or more amino acid residues corresponding to residues E34, W39, W41, F70, and G72 of SEQ ID NO: 25 (Luk26). Accordingly, the FN3 domain binding molecule containing a LukE binding region comprises an amino acid sequence that is at least 70%, 75%, 80%, 85%, 86%, 87%, 88%, 89%, 90%, 91%, 92%, 93%, 94%, 95%, 96%, 97%, 98%, or 99% identical to the amino acid sequence of SEQ ID NO: 25, where residues E34, W39, W41, F70, and G72 of SEQ ID NO: 25 remain fixed or are substituted with functionally equivalent amino acid residues.

In another embodiment, a LukE binding molecule described herein comprises a C strand and a CD loop region having the amino acid sequence DSFX$_{32}$IX$_{34}$YX$_{36}$EX$_{38}$X$_{39}$X$_{40}$X$_{41}$GE (SEQ ID NO: 995) where
X$_{32}$ is any amino acid residue,
X$_{34}$ is any amino acid residue,
X$_{36}$ is any amino acid residue,
X$_{38}$ is W or a functionally equivalent amino acid residue,
X$_{39}$ is any amino acid residue,
X$_{40}$ is any amino acid residue, and
X$_{41}$ is any amino acid residue;
and an F strand and FG loop region having the amino acid sequence of TEYX$_{68}$VX$_{70}$IX$_{72}$GVKGG X$_{78}$ X$_{79}$ SX$_{81}$ (SEQ ID NO: 996), where
X$_{68}$ is L or a functionally equivalent amino acid residue,
X$_{70}$ is D or a functionally equivalent amino acid residue,
X$_{72}$ is Y or a functionally equivalent amino acid residue,
X$_{78}$ is any amino acid residue,
X$_{79}$ is W or a functionally equivalent amino acid residue, and
X$_{81}$ is Y or a functionally equivalent amino acid residue.

In one embodiment, the LukE binding molecule as described herein comprises the a C strand and a CD loop region of SEQ ID NO: 995 and the F strand and FG loop region of SEQ ID NO: 996 as described above and binds to a neutralizing epitope of LukE in one of the regions of LukE noted above, i.e., amino acid residues 22-33, 123-128, 137-142, 68-86, 151-161, 175-189, 193-207, and 248-278 of SEQ ID NO:1055.

In one embodiment, the LukE binding molecule as described herein comprises the amino acid sequence of LPAPKNLVVSRVTEDSARLSWTAPDAAFDSF X$_{32}$I X$_{34}$Y X$_{36}$E X$_{38}$ X$_{39}$ X$_{40}$ X$_{41}$ GEAI VLTVPGSERSYDLT-GLKPGT EY X$_{68}$V X$_{70}$I X$_{72}$GVKG G X$_{78}$ X$_{79}$ S X$_{81}$ PLSAIFTT (SEQ ID NO: 990) where,
X$_{32}$ is any amino acid residue,
X$_{34}$ is any amino acid residue,
X$_{36}$ is any amino acid residue,
X$_{38}$ is W or a functionally equivalent amino acid residue,
X$_{39}$ is any amino acid residue,
X$_{40}$ is any amino acid residue,
X$_{41}$ is any amino acid residue,
X$_{68}$ is L or a functionally equivalent amino acid residue,
X$_{70}$ is D or a functionally equivalent amino acid residue,
X$_{72}$ is Y or a functionally equivalent amino acid residue,
X$_{78}$ is any amino acid residue,
X$_{79}$ is W or a functionally equivalent amino acid residue, and
X$_{81}$ is Y or a functionally equivalent amino acid residue.

In accordance with this embodiment, exemplary LukE binding molecules include any one of the amino acid sequences of SEQ ID Nos: 26 (Luk27) and 815-827. In some embodiments, these LukE binding molecules comprise an initiator methionine residue linked to the N-terminus or a cysteine residue linked to the C-terminus to facilitate expression and/or conjugation to another moiety (e.g., another leukotoxin binding FN3 domain, a half-life extending moiety, or other therapeutic moiety).

In one embodiment, the LukE binding molecule as described herein binds LukE with one or more amino acid residues corresponding to residues W38, L68, D70, Y72, W79, and Y81 of SEQ ID NO: 26 (Luk27). Accordingly, the FN3 domain containing a LukE binding region comprises an amino acid sequence that is at least 70%, 75%, 80%, 85%, 86%, 87%, 88%, 89%, 90%, 91%, 92%, 93%, 94%, 95%, 96%, 97%, 98%, or 99% identical to the amino acid sequence of SEQ ID NO: 26, where residues W38, L68, D70, Y72, W79, and Y81 of SEQ ID NO: 26 remain fixed or are substituted with functionally equivalent amino acid residues.

In another embodiment, the LukE binding molecule described herein comprises a FG loop region having the amino acid sequence X$_{75}$ X$_{76}$ X$_{77}$ X$_{78}$ X$_{79}$ X$_{80}$X$_{81}$ X$_{82}$ X$_{83}$ X$_{84}$ X$_{85}$ X$_{86}$ (SEQ ID NO: 997) where
X$_{75}$ is any amino acid residue,
X$_{76}$ is any amino acid residue,
X$_{77}$ is I or a functionally equivalent amino acid residue,
X$_{78}$ is any amino acid residue,
X$_{79}$ is any amino acid residue,
X$_{80}$ is G or a functionally equivalent amino acid residue,
X$_{81}$ is W or a functionally equivalent amino acid residue,
X$_{82}$ is L or a functionally equivalent amino acid residue,
X$_{83}$ is D or a functionally equivalent amino acid residue,
X$_{84}$ is F or a functionally equivalent amino acid residue,
X$_{85}$ is V or a functionally equivalent amino acid residue, and
X$_{86}$ is F or a functionally equivalent amino acid residue.

In one embodiment, the FG loop region of SEQ ID NO: 997 can contain one or more amino acid insertions. For example, amino acid insertions of 1, 2, 3, 4, 5, 6, 7, 8, 9, 10, or more amino acid residues can be made at or around positions X$_{75}$ and X$_{76}$ of SEQ ID NO: 997 or SEQ ID NO: 991. Likewise, amino acid insertions of 1, 2, 3, 4, 5, 6, 7, 8, 9, 10 or more amino acid residues can be made at or around positions X$_{78}$ and X$_{79}$ of SEQ ID NO: 997 or SEQ ID NO: 991.

In one embodiment, the LukE binding molecule as described herein comprises the FG loop region of SEQ ID NO: 997 as described above and binds to a neutralizing epitope of LukE in one of the regions of LukE noted above, i.e., amino acid residues 22-33, 123-128, 137-142, 68-86, 151-161, 175-189, 193-207, and 248-278 of SEQ ID NO:1055.

In accordance with this embodiment, the LukE binding molecule as described herein comprises the amino acid sequence of LPAPKNLVVSRVTEDSARLSWTAPDAAF-DSFLIQYQESEKVGEAIVLTVPGSERSYDLTG LKPGTEYTVSIYGV X$_{75}$ X$_{76}$ X$_{77}$ X$_{78}$ X$_{79}$ X$_{80}$X$_{81}$ X$_{82}$ X$_{83}$ X$_{84}$ X$_{85}$ X$_{86}$ SNPLSAIFTT (SEQ ID NO: 991), where
X$_{75}$ is any amino acid residue,
X$_{76}$ is any amino acid residue,
X$_{77}$ is I or a functionally equivalent amino acid residue
X$_{78}$ is any amino acid residue,
X$_{79}$ is any amino acid residue,
X$_{80}$ is G or a functionally equivalent amino acid residue
X$_{81}$ is W or a functionally equivalent amino acid residue
X$_{82}$ is L or a functionally equivalent amino acid residue,
X$_{83}$ is D or a functionally equivalent amino acid residue,
X$_{84}$ is F or a functionally equivalent amino acid residue,
X$_{85}$ is V or a functionally equivalent amino acid residue, and
X$_{86}$ is F or a functionally equivalent amino acid residue.

In accordance with this embodiment, exemplary LukE binding molecules comprise any one of the amino acid sequences of SEQ ID Nos: 37 (Luk38) and 828-839. In some embodiments, these LukE binding molecules comprise an initiator methionine residue linked to the N-terminus or a cysteine residue linked to the C-terminus to facilitate expression and/or conjugation to another moiety (e.g., another leukotoxin binding FN3 domain, a half-life extending moiety, or other therapeutic moiety).

In another embodiment, the LukE binding molecule as described herein binds LukE with one or more amino acid residues corresponding to residues I77, G80, W81, L82, D83, F84, V85, and F86 of SEQ ID NO: 37 (Luk38). In one embodiment, the FN3 domain containing a LukE binding region comprises an amino acid sequence that is at least 70%, 75%, 80%, 85%, 86%, 87%, 88%, 89%, 90%, 91%, 92%, 93%, 94%, 95%, 96%, 97%, 98%, or 99% identical to the amino acid sequence of SEQ ID NO: 37.

Additional exemplary LukE binding molecules are disclosed herein. Accordingly, an exemplary LukE binding molecule of the present disclosure comprises any one of the amino acid sequences of SEQ ID NOs: 27, 28, 29, 30, 31, 32, 33, 34, 35, 36, 38, 39, 40, 41, 42, 43, 44, 45, 46, 47, 48, 49, 50, 51, 52, 53, 54, 55, 56, 57, 58, 59, 113, 116, 117, 118, 119, 120, 121, 122, 123, 124, 125, 126, 127, 128, 129, 130, 131, 132, 133, 134, 135, 136, 155, 363, 364, 366, 367, 368, 369, 375, 376, 388, and 586, or an amino acid sequence that is at least 70%, 75%, 85%, 86%, 87%, 88%, 89%, 90%, 91%, 92%, 93%, 94%, 95%, 96%, 97%, 98%, or 99% identical to any one of the amino acid sequences of SEQ ID NOs: 27, 28, 29, 30, 31, 32, 33, 34, 35, 36, 38, 39, 40, 41, 42, 43, 44, 45, 46, 47, 48, 49, 50, 51, 52, 53, 54, 55, 56, 57, 58, 59, 113, 116, 117, 118, 119, 120, 121, 122, 123, 124, 125, 126, 127, 128, 129, 130, 131, 132, 133, 134, 135, 136, 155, 363, 364, 366, 367, 368, 369, 375, 376, 388, and 586. In some embodiments, these LukE binding molecules comprise an initiator methionine residue linked to the N-terminus or a cysteine residue linked to the C-terminus to facilitate expression and/or conjugation to another moiety (e.g., another leukotoxin binding FN3 domain, a half-life extending moiety, or other therapeutic moiety).

In another aspect, the binding molecule described herein comprises a FN3 domain having one or more modified loop regions that comprise one or more LukA and/or LukB binding regions. This binding molecule is capable of binding a LukA protein having the amino acid sequence of SEQ ID NO: 671 or a fragment or homolog thereof, and/or a LukB protein having the amino acid sequence of SEQ ID NO: 11 or a fragment or homolog thereof. In one embodiment, the binding molecule neutralizes LukAB activity, e.g., by inhibiting LukA and LukB interaction or by inhibiting LukAB binding to the host immune cells. In accordance with this embodiment, the binding molecule binds to one or more neutralizing epitopes of LukA and/or neutralizing epitopes of LukB. As described in more detail in the Examples herein, amino acid residues 201-224 and 260-269 of SEQ ID NO: 11 comprise regions of LukB that contain neutralizing epitopes.

In one embodiment, a LukAB binding molecule as described herein comprises a C strand and a CD loop region having the amino acid sequence DSFX$_{32}$IX$_{34}$YX$_{36}$EX$_{38}$X$_{39}$X$_{40}$X$_{41}$X$_{42}$E (SEQ ID NO: 998), where X$_{32}$ is W or a functionally equivalent amino acid residue, X$_{34}$ is any amino acid residue,
X$_{36}$ is E or a functionally equivalent amino acid residue,
X$_{38}$ is K or a functionally equivalent amino acid residue,
X$_{39}$ is F or a functionally equivalent amino acid residue,
X$_{40}$ is Y or a functionally equivalent amino acid residue,
X$_{41}$ is R or a functionally equivalent amino acid residue, and
X$_{42}$ is any amino acid residue;
and an F strand and FG loop region having the amino acid sequence of TX$_{66}$YX$_{68}$VX$_{70}$IX$_{72}$GVKG X$_{77}$ X$_{78}$ X$_{79}$ SX$_{81}$ (SEQ ID NO: 999), where
X$_{66}$ is any amino acid residue,
X$_{68}$ is K or a functionally equivalent amino acid residue,
X$_{70}$ is W or a functionally equivalent amino acid residue,
X$_{72}$ is any amino acid residue,
X$_{77}$ is any amino acid residue,
X$_{78}$ is any amino acid residue,
X$_{79}$ is any amino acid residue, and
X$_{81}$ is W or a functionally equivalent amino acid residue.

In one embodiment, the LukAB binding molecule as described herein comprises the C strand and a CD loop region of SEQ ID NO: 998, and the F strand and FG loop region of SEQ ID NO: 999 as described above and binds to a neutralizing epitope of LukB in one of the regions of LukB identified above, i.e., amino acid residues 201-224 and/or 260-269 of SEQ ID NO:11.

In accordance with this embodiment, an exemplary LukAB binding molecule as described herein comprises the amino acid sequence of LPAPKNLVVSRVTED-SARLSWTAPDAAFDSF X$_{32}$I X$_{34}$Y X$_{36}$E X$_{38}$ X$_{39}$ X$_{40}$ X$_{41}$ X$_{42}$EAI X$_{46}$LTVPGSERSYDLTGLKPGTX$_{66}$Y X$_{68}$V X$_{70}$l X$_{72}$GVKG X$_{77}$ X$_{78}$ X$_{79}$ S X$_{81}$ X$_{82}$L X$_{84}$A X$_{86}$FTT (SEQ ID NO: 992), where
X$_{32}$ is W or a functionally equivalent amino acid residue,
X$_{34}$ is any amino acid residue,
X$_{36}$ is E or a functionally equivalent amino acid residue,
X$_{38}$ is K or a functionally equivalent amino acid residue,
X$_{39}$ is F or a functionally equivalent amino acid residue,
X$_{40}$ is Y or a functionally equivalent amino acid residue,
X$_{41}$ is R or a functionally equivalent amino acid residue,
X$_{42}$ is any amino acid residue,
X$_{42}$ is any amino acid residue,
X$_{46}$ is any amino acid residue,
X$_{66}$ is any amino acid residue,
X$_{68}$ is K or a functionally equivalent amino acid residue,
X$_{70}$ is W or a functionally equivalent amino acid residue,
X$_{72}$ is any amino acid residue,
X$_{77}$ is any amino acid residue,
X$_{78}$ is any amino acid residue,
X$_{79}$ is any amino acid residue,
X$_{81}$ is W or a functionally equivalent amino acid residue,
X$_{82}$ is any amino acid residue
X$_{84}$ is any amino acid residue, and
X$_{86}$ is any amino acid residue.

In accordance with this embodiment, exemplary LukAB binding molecules comprise any one of the amino acid sequences of SEQ ID Nos: 14 (Luk17) and 672-738. In some embodiments, these LukAB binding molecules comprise an initiator methionine residue linked to the N-terminus or a cysteine residue linked to the C-terminus to facilitate expression and/or conjugation to another moiety (e.g., another leukotoxin binding FN3 domain, a half-life extending moiety, or other therapeutic moiety).

In another embodiment, the LukAB binding molecule as described herein binds LukAB with one or more amino acid residues corresponding to residues W32, T34, E36, K38, F39, Y40, R41, A44, V46, E66, K68, W70, V72, W81, and P82 of SEQ ID NO: 14 (Luk17). In one embodiment, the FN3 domain containing a LukAB binding region comprises an amino acid sequence that is at least 70%, 75%, 85%, 86%, 87%, 88%, 89%, 90%, 91%, 92%, 93%, 94%, 95%, 96%, 97%, 98%, or 99% identical to the amino acid sequence of SEQ ID NO: 14, where amino acid residues W32, T34, E36, K38, F39, Y40, R41, A44, V46, E66, K68, W70, V72, W81, and P82 of SEQ ID NO: 14 remain fixed or are substituted with functionally equivalent amino acid residues.

Additional exemplary LukAB binding molecules are disclosed herein. Accordingly, an exemplary LukAB binding molecule of the present disclosure comprises any one of the amino acid sequences of SEQ ID NOs: 15, 16, 17, 145, 156, 158, 167, 214, 226, 247, 282, 286, 316, 370, 386, 388, 392, 446, 454, 462, 530, 540, 568, 574, 584, 587, 588, 589, 590, 591, 592, 593, 594, 595, 596, 597, 598, 599, 600, 601, 602, 603, 604, 605, 606, 607, 608, 609, 610, 611, 612, 613, 614, 615, 616, 617, 618, 619, 620, 621, 622, 623, 624, 625, 626, 627, 628, 629, 630, 631, 632, 633, 634, 635, 636, 637, 638, 639, 640, 641, 642, 643, 644, 645, 646, 647, 648, 649, 650, 651, 652, 653, 654, 655, 656, 657, 658, 659, 660, 661, 662, 663, 664, 665, 666 as well as an amino acid sequence that is at least 70%, 75%, 85%, 86%, 87%, 88%, 89%, 90%, 91%, 92%, 93%, 94%, 95%, 96%, 97%, 98%, or 99% identical to any one of the amino acid sequences of SEQ ID NOs: 15, 16, 17, 145, 156, 158, 167, 214, 226, 247, 282, 286, 316, 370, 386, 388, 392, 446, 454, 462, 530, 540, 568, 574, 584, 587, 588, 589, 590, 591, 592, 593, 594, 595, 596, 597, 598, 599, 600, 601, 602, 603, 604, 605, 606, 607, 608, 609, 610, 611, 612, 613, 614, 615, 616, 617, 618, 619, 620, 621, 622, 623, 624, 625, 626, 627, 628, 629, 630, 631, 632, 633, 634, 635, 636, 637, 638, 639, 640, 641, 642, 643, 644, 645, 646, 647, 648, 649, 650, 651, 652, 653, 654, 655, 656, 657, 658, 659, 660, 661, 662, 663, 664, 665, 666 In some embodiments, these LukAB binding molecules comprise an initiator methionine residue linked to the N-terminus or a cysteine residue linked to the C-terminus to facilitate expression and/or conjugation to another moiety (e.g., another leukotoxin binding FN3 domain, a half-life extending moiety, or other therapeutic moiety).

Another aspect of the present disclosure is directed to a binding molecule comprising one or more modified fibronectin type III (FN3) domains, where the modified FN3 domain contains one or more loop regions that comprise one or more staphylococcal hemolysin binding regions. In one embodiment, the binding molecule described herein comprises a FN3 domain having one or more modified loop regions that comprise one or more staphylococcal alpha-hemolysin (Hla) binding regions. This binding molecule is capable of binding an Hla protein having the amino acid sequence of SEQ ID NO: 1086 or fragments or homologs thereof. In one embodiment, the binding molecule neutralizes Hla activity, e.g., Hla mediated pore formation and cell death. In accordance with this embodiment, the binding molecule binds to one or more neutralizing epitopes of Hla.

In accordance with this embodiment, exemplary Hla binding molecules comprise any one of the amino acid sequences of SEQ ID Nos: 1097, 1099, 1112, 1142, and 1100, as well as amino acid sequences that are at least 70%, 75%, 85%, 86%, 87%, 88%, 89%, 90%, 91%, 92%, 93%, 94%, 95%, 96%, 97%, 98%, or 99% identical to any one of the amino acid sequences of SEQ ID NOs: 1097, 1099, 1112, 1142, and 1100. In some embodiments, these Hla binding molecules comprise an initiator methionine residue linked to the N-terminus or a cysteine residue linked to the C-terminus to facilitate expression and/or conjugation to another moiety (e.g., another leukotoxin binding FN3 domain, a half-life extending moiety, or other therapeutic moiety).

In one embodiment, the binding molecule as disclosed herein is a monospecific binding molecule. In another embodiment, the binding molecule as disclosed herein is a bispecific binding molecule. A bispecific binding molecule of the present disclosure is a molecule comprising a first FN3 domain having a first staphylococcal leukotoxin binding region and a second FN3 domain having a second staphylococcal leukotoxin binding region that is distinct from the first staphylococcal leukotoxin binding region. In another embodiment, the binding molecule of the present disclosure is a multispecific binding molecule. A multispecific binding molecule as described herein is a molecule having at least a first, a second, and a third FN3 domain, each FN3 domain having a distinct staphylococcal leukotoxin binding region, i.e., the binding molecule comprises at least first, second, and third staphylococcal leukotoxin binding regions that are each distinct from each other. Bispecific and multispecific binding molecules as disclosed herein can be generated by covalently linking any first staphylococcal leukotoxin binding FN3 domain and any second or third or more staphylococcal leukotoxin binding FN3 domains directly or via a linker. Suitable linkers include peptides composed of repetitive modules of one or more of the amino acids, such as glycine and serine or alanine and proline. Exemplary linker peptides include, e.g., (Gly-Gly)$_n$, (Gly-Ser)$_n$, (Gly$_3$-Ser)$_n$, (Ala-Pro)$_n$ whereinn is an integer from 1-25. The length of the linker may be appropriately adjusted as long as it does not affect the function of the binding molecule. The standard 15 amino acid (Gly$_4$-Ser)$_3$ linker peptide has been well-characterized (e.g., within the context of an antibody single-chain Fv (scFv) domain) and has been shown to adopt an unstructured, flexible conformation. In addition, this linker peptide does not interfere with assembly and binding activity of the domains it connects (Freund et al., "Characterization of the Linker Peptide of the Single-Chain Fv Fragment of an Antibody by NMR Spectroscopy," *FEBS* 320:97 (1993), the disclosure of which is hereby incorporated by reference in its entirety).

In one embodiment, a bispecific binding molecule of the present disclosure comprises a first FN3 domain having a staphylococcal LukE binding region, e.g., any of the FN3 domain LukE binding regions described supra, coupled to a second FN3 domain having a different leukotoxin binding region. In one embodiment, the second FN3 domain comprises a LukAB binding region, e.g., any of the FN3 domain LukAB binding regions described supra. In one embodiment, the bi-specific binding molecule has a FN3 domain binding LukE that comprises an amino acid sequence of any one of SEQ ID NOs: 989, 990, or 991, and the FN3 domain binding LukAB that comprises an amino acid sequence of SEQ ID NO: 992. In another embodiment, the FN3 domain binding LukE comprises any one of the amino acid sequences selected from SEQ ID NOs: 25-59, 113,116-136, 155, 363, 364, 366-369, 375, 376, 388, 586, and 739-839, and the FN3 domain binding LukAB comprises any one of the amino acid sequences selected from SEQ ID NOs: 14, 15, 16, 17, 145, 156, 158, 167, 214, 226, 247, 282, 286, 316, 370, 386, 388, 392, 446, 454, 462, 530, 540, 568, 574, 584, 587-666 and 672-738.

The FN3 domains specifically binding a staphylococcal leukotoxin as described herein can be modified to improve their properties such as thermal stability and reversibility of thermal folding and unfolding. Several methods have been applied to increase the apparent thermal stability of proteins and enzymes, including rational design based on comparison to highly similar thermostable sequences, design of stabilizing disulfide bridges, mutations to increase alpha-helix propensity, engineering of salt bridges, alteration of the surface charge of the protein, directed evolution, and composition of consensus sequences (Lehmann and Wyss, *Curr Opin Biotechnol*, 12: 371-375 (2001), which is hereby incorporated by reference in its entirety). High thermal stability may increase the yield of the expressed protein, improve solubility or activity, decrease immunogenicity, and minimize the need of a cold chain in manufacturing. Residues that can be substituted to improve thermal stability of Tencon (SEQ ID NO: 1017) or Tencon 25 (SEQ ID NO: 1) include, without limitation, residues at positions 11, 14, 17, 37, 46, 73, or 86, and are described in U.S. Patent Publication No. 2011/0274623 to Jacobs et al., which is hereby incorporated by reference in its entirety. Substitutions corresponding to these residues can be incorporated to the FN3 domains or the monospecific, bispecific, or multispecific FN3 domain containing binding molecules of the disclosure.

The binding molecule of the present disclosure is preferably an "isolated" binding molecule. "Isolated" when used to describe the binding molecule disclosed herein, means a binding molecule that has been identified, separated and/or recovered from a component of its production environment. Preferably, the isolated binding molecule is free of association with all other components from its production environment. Contaminant components of its production environment, such as that resulting from recombinant transfected cells, are materials that would typically interfere with diagnostic or therapeutic uses for the polypeptide, and may include enzymes, hormones, and other proteinaceous or non-proteinaceous solutes. In preferred embodiments, the binding molecule will be purified (1) to a degree sufficient to obtain at least 15 residues of N-terminal or internal amino acid sequence by use of a spinning cup sequenator, or (2) to homogeneity by SDS-PAGE under non-reducing or reducing conditions using Coomassie blue or, preferably, silver stain. Ordinarily, however, an isolated binding molecule will be prepared by at least one purification step.

As described supra, amino acid sequence modifications of the binding molecules described herein are contemplated. For example, it may be desirable to improve the binding affinity and/or other biological properties of the binding molecule. Amino acid sequence variants of the binding molecules are prepared by introducing appropriate nucleotide changes into the binding molecules nucleic acid, or by peptide synthesis. Such modifications include, for example, deletions from, and/or insertions into, and/or substitutions of, residues within the amino acid sequences of the binding molecules. Any combination of deletion, insertion, and substitution is made to arrive at the final construct, provided that the final construct possesses the desired characteristics, such as abolishment of protein A binding and FcγRI binding, or protease-resistance.

Exemplary modifications are for example conservative substitutions or functionally equivalent amino acid residue substitution and include those that will result in variants with similar characteristics to those of the parent binding molecules and fusion constructs described infra. Conservative substitutions are those that take place within a family of amino acids that are related in their side chains. Genetically encoded amino acids can be divided into four families: (1) acidic (aspartate, glutamate); (2) basic (lysine, arginine, histidine); (3) nonpolar (alanine, valine, leucine, isoleucine, proline, phenylalanine, methionine, tryptophan); and (4) uncharged polar (glycine, asparagine, glutamine, cysteine, serine, threonine, tyrosine). Phenylalanine, tryptophan, and tyrosine are sometimes classified jointly as aromatic amino acids. Alternatively, the amino acid repertoire can be grouped as (1) acidic (aspartate, glutamate); (2) basic (lysine, arginine histidine), (3) aliphatic (glycine, alanine, valine, leucine, isoleucine, serine, threonine), with serine and threonine optionally grouped separately as aliphatic-hydroxyl; (4) aromatic (phenylalanine, tyrosine, tryptophan); (5) amide (asparagine, glutamine); and (6) sulfur-containing (cysteine and methionine) (Stryer (ed.), Biochemistry, 2nd ed, WH Freeman and Co., 1981, which is hereby incorporated by reference in its entirety). Non-conservative substitutions can be made to the binding molecules that involve substitutions of amino acid residues between different classes of amino acids to improve properties of the binding molecules and fusion constructs. Whether a change in the amino acid sequence of a polypeptide or fragment thereof results in a functional homolog can be readily determined by assessing the ability of the modified binding molecule to produce a response in a fashion similar to the unmodified binding molecule using assays described herein.

Another aspect of the present disclosure is directed to a fusion construct comprising a first portion comprising one or more binding molecules as described herein, and a second portion coupled to said first portion. The second portion of the fusion construct may comprise a second binding molecule, a pharmaceutically active moiety, a prodrug, a pharmaceutically-acceptable carrier, a diagnostic moiety, a cell penetrating enhancer moiety, a half-life extending modulating moiety, and any combination thereof.

In accordance with this aspect of the present disclosure, the first and second portions of the fusion construct are covalently coupled either directly or via a linker as described supra. The first and second portions may be directly fused and generated by standard cloning and expression techniques. Alternatively, well known chemical coupling methods may be used to attach the portions directly or via a peptide or other linker to recombinantly produce fusion constructs as described herein.

In one embodiment, the second portion of the fusion construct of the present disclosure comprises a half-life extending moiety. Exemplary half-life extending moieties include, without limitation, albumin, albumin variants (see e.g., U.S. Pat. No. 8,822,417 to Andersen et al., U.S. Pat. No. 8,314,156 to Desai et al., and U.S. Pat. No. 8,748,380 to Plumridge et al., which are hereby incorporated by reference in their entirety), albumin-binding proteins and/or domains, transferrin and fragments and analogues thereof (see e.g., U.S. Pat. No. 7,176,278 to Prior et al., which are hereby incorporated by reference in their entirety), Fc regions and variant Fc regions (see e.g., U.S. Pat. No. 8,546,543 to Lazar et al., U.S. Patent Publication No. 20150125444 to Tsui, and U.S. Pat. No. 8,722,615 to Seehra et al., which are hereby incorporated by reference in their entirety).

Other second portion half-life extending moieties of the fusion construct include, without limitation, polyethylene glycol (PEG) molecules, such as PEG5000 or PEG20,000, fatty acids and fatty acid esters of different chain lengths, for example laurate, myristate, stearate, arachidate, behenate, oleate, arachidonate, octanedioic acid, tetradecanedioic acid, octadecanedioic acid, docosanedioic acid, and the like, polylysine, octane, carbohydrates (dextran, cellulose, oligo- or polysaccharides) for desired properties. A pegyl moiety may for example be added to the bispecific or monospecific molecules of the disclosure by adding a cysteine residue to the C-terminus of the molecule and attaching a pegyl group to the cysteine using methods well known in the art.

In another embodiment, the second portion of the fusion construct comprises a pharmaceutically active moiety, such as, e.g., a cytokine, a toxin, a chemokine, an antibacterial peptide, an antibiotic, an enzyme, a peptide or protein with specific target binding characteristics, a fluorescent dye, a photosensitizer, a radionuclide, a contrast agent for medical imaging, a toxic compound, a pro-coagulant factor, an enzyme for pro-drug activation, an albumin binder, an albumin, an IgG binder or polyethylene glycol.

In another embodiment, the second portion of the fusion construct comprises a cell penetrating peptide (CPPs). CPPs translocate across the plasma membrane of eukaryotic cells by a seemingly energy-independent pathway and have been used successfully for intracellular delivery of macromolecules, including antibodies, peptides, proteins, and nucleic acids, with molecular weights several times greater than their own. Several commonly used CPPs, including polyarginines, transportant, protamine, maurocalcine, and M918 are known in the art (see Stewart et al., "Cell-Penetrating Peptides as Delivery Vehicles for Biology and Medicine," *Organic Biomolecular Chem* 6:2242-2255 (2008), which is hereby incorporated by reference in its entirety). In another embodiment, the second portion of the fusion construct comprises a cell penetrating enhancer moiety. Suitable cell penetrating enhancer moieties include, without limitation, oligo-arginyl derivatives (Bersani et al., *Bioconjug. Chem.* 23(7):1415-25 (2012), which is hereby incorporated by reference in its entirety), and corona-like (guanidyl)-oligosaccharidic derivatives (see WO2012/097876 To Caliceti et al., which is hereby incorporated by reference in its entirety).

In another embodiment, the second portion of the fusion construct comprises a diagnostic moiety. Suitable diagnostic moieties are those that facilitate the detection, quantitation, separation, and/or purification of the fusion construct. Suitable diagnostic moieties include, without limitation, purification tags (e.g., poly-histidine ($His_6$), glutathione-S-transferase (GST-), or maltose-binding protein (MBP-)), fluorescent tags (e.g., chelates (europium chelates), fluorescein and its derivatives, rhodamine and its derivatives, dansyl, Lissamine, phycoerythrin and Texas Red), an enzymatic tag, a radioisotope or radioactive label, a contrast agent suitable for imaging, or a photosensitize.

In another embodiment, the second portion of the fusion construct comprises a second binding molecule. In one aspect, the second binding molecule is an antibody or antibody binding domain thereof. As used herein, an "antibody" includes any protein or peptide containing molecule that comprises at least a portion of an immunoglobulin molecule, such as but not limited to, at least one, at least two, or at least three complementarity determining region (CDR) of a heavy or light chain, a heavy chain or light chain variable region, a heavy chain or light chain constant region, a framework region, or any portion thereof. Antibodies encompass full antibodies, digestion fragments, specified portions and variants thereof, including, without limitation, portions of antibodies that mimic the structure and/or function of an antibody or specified fragment or portion thereof, including, without limitation, single chain antibodies, single domain antibodies (i.e., antibody fragments comprising merely one variable domain, which might be VHH, VH or VL, that specifically bind an antigen or epitope independently of other V regions or domains). Functional fragments include antigen-binding fragments that bind to a particular target. For example, antibody fragments capable of binding to a particular target or portions thereof, include, but are not limited to, Fab (e.g., by papain digestion), Fab' (e.g., by pepsin digestion and partial reduction) and $F(ab')_2$ (e.g., by pepsin digestion), facb (e.g., by plasmin digestion), pFc' (e.g., by pepsin or plasmin digestion), Fd (e.g., by pepsin digestion, partial reduction and reaggregation), Fv or scFv (e.g., by molecular biology techniques) fragments.

Such fragments can be produced by enzymatic cleavage, synthetic or recombinant techniques, as known in the art and/or as described herein. Antibodies can also be produced in a variety of truncated forms using antibody genes in which one or more stop codons have been introduced upstream of the natural stop site. For example, a combination gene encoding a $F(ab')_2$ heavy chain portion can be designed to include DNA sequences encoding the $CH_1$ domain and/or hinge region of the heavy chain. The various portions of antibodies can be joined together chemically by conventional techniques, or can be prepared as a contiguous protein using genetic engineering techniques.

Furthermore, the term "antibody" encompasses monoclonal and polyclonal antibodies, as well as human, humanized, or chimeric antibodies, and derivatives or variants of the antibodies described herein which display the same specificity as the described antibodies. Examples of "antibody variants" include humanized variants of non-human antibodies, "affinity matured" antibodies (see e.g., Hawkins et al., "Selection of Phage Antibodies by Binding Affinity. Mimicking Affinity Maturation," *J. Mol. Biol.* 254:889-896 (1992) and Lowman et al., "Selecting High-Affinity Binding Proteins by Monovalent Phage Display," *Biochemistry* 30:10832-10837 (1991), each of which is hereby incorporated by reference in its entirety) and antibody mutants with altered effector function(s) (see, e.g., U.S. Pat. No. 5,648,260 to Winter et al., Kontermann and DUbel, ANTIBODY ENGINEERING, Springer, $2^{nd}$ ed. 2010, and Little, RECOMBINANT ANTIBODIES FOR IMMUNOTHERAPY, Cambridge University Press, 2009, each of which is hereby incorporated by reference in its entirety).

In another embodiment, the second binding molecule comprises an antibody mimetic, i.e., an organic compound, often a peptide, polypeptide, or protein that binds specifically to an antigen, but is structurally unrelated to an antibody. Exemplary antibody mimetics include, without limitation, affibodies (scaffold based on the Z domain of Protein A), affilins (scaffold based on the structure of gamma crystallin or ubiquitin), affimers (scaffold based on the structure of cystatins), affitins (scaffold derived from the DNA binding protein Sac7d), alphabodies (scaffold based on a coiled coil structure), anticalins (scaffold derived from lipocalins), avimers (scaffold derived from A domains of various membrane receptors), DARPins (scaffold derived from ankyrin repeat motif), fynomers (scaffold derived from SH3 domain of Fyn), and Kunitz domain (scaffold derived from Kunitz domains of various protease inhibitors).

The second binding molecule may be a monospecific, bispecific, or multi-specific binding molecule, i.e., the second binding molecule has one, two, or multiple distinct binding sites for binding one or more distinct protein targets. The second binding molecule may be a monovalent, bivalent, or multi-valent, i.e., the second binding molecule has one, two, or multiple binding sites for a particular target molecule. For example, the second binding molecule may comprise an antibody that is monospecific, bispecific, or tri-specific, and the antibody may be monovalent, bivalent, or multi-valent. In one embodiment, the antibody is a mono-specific, bivalent antibody.

In one embodiment, the carboxy terminus of the second binding molecule is coupled to the amino terminus of the binding molecule of the present disclosure. In another embodiment the carboxy terminus of the second binding molecule is coupled to the carboxy terminus of the binding molecule of the present disclosure. When the second binding molecule comprises an antibody, one or more of the same or distinct binding molecules may be coupled to the light chain and/or the heavy chain of the antibody, or binding fragments thereof. In one embodiment, one or more of the same or distinct binding molecules are coupled to one or more of the heavy chains of an antibody. In another embodiment, one or more of the same or distinct binding molecules are coupled to one or more of the light chains of an antibody. In another embodiment, one or more distinct binding molecules are coupled to one or more of the light chains and the heavy chains of an antibody.

In one aspect, the second binding molecule is resistant to proteolytic degradation by a staphylococcal protease that cleaves wild-type IgG1 (such as the staphylococcal protease,

*Staphylococcus aureus* V8 protease, that cleaves wild-type IgG1 between or at residues 222-237 (EU numbering) within SEQ ID NO: 60) (see U.S. Pat. No. 8,871,204 to Strohl et al., which is hereby incorporated by reference in its entirety).

In one aspect, the second binding molecule is not capable of specific binding to human FcγRI, is not capable of specific binding to Protein A, and is not capable of specific binding to Sbi. In one aspect, the second binding molecule is capable of specific binding to FcRn.

In one embodiment, the second binding molecule of the fusion construct has binding specificity for a staphylococcal protein. In one embodiment, the second binding molecule has binding specificity for a staphylococcal virulence factor. As used herein a "virulence factor" refers to a molecule expressed by staphylococcal protein that enables the bacteria to achieve colonization of a niche in the host (including adhesion to cells), immunoevasion (i.e., evasion of the host's immune response), immunosuppression (i.e., inhibition of the host's immune response), entry into and exit out of cells (if the pathogen is an intracellular one), and/or obtain nutrition from the host. The virulence factor may be encoded on mobile genetic elements, such as bacteriophages, and can easily be spread through horizontal gene transfer. Non-limiting examples of *Staphylococcus aureus* virulence factors include hyaluronidase, protease, coagulase, lipases, deoxyribonucleases, enterotoxins and other toxins. For purposes of this disclosure, staphylococcal surface proteins, such as SDR-containing proteins, e.g., ClfA, ClfB, SdrC, SdrD, SdrE, SdrF, SdrG and SdrH, are also considered virulence factors.

In one embodiment, the second binding molecule of the fusion construct of the present disclosure is capable of binding to a glycosylated staphylococcal surface protein. Exemplary second binding molecules that bind a glycosylated staphylococcal surface protein include the antibodies and antibody binding domain fragments disclosed in U.S. Pat. Nos. 8,460,666 and 8,211,431 to Throsby et al., which is hereby incorporated by reference in its entirety. In one embodiment, the antibody or antibody binding domain that binds a glycosylated staphylococcal surface protein has an immunoglobulin heavy chain comprising an amino acid sequence selected from SEQ ID NOs: 60, 62, 64 or 66. In another embodiment, the antibody or antibody binding domain that binds a glycosylated staphylococcal surface protein has an immunoglobulin light chain comprising an amino acid sequence of SEQ ID NOs: 61, 63, 65 or 67. Alternatively, the second binding molecule comprises an antibody having (a) a heavy chain having the amino acid sequence of SEQ ID NOs:60, 62, 64 or 66; and (b) a light chain having the amino acid sequence of SEQ ID NOs:61, 63, 65 or 67. In another embodiment, the second binding molecule comprises an antibody having (1) a heavy chain having the amino acid sequence of SEQ ID NO:60, and a light chain having the amino acid sequence of SEQ ID NO:61; (2) a heavy chain having the amino acid sequence of SEQ ID NO:62, and a light chain having the amino acid sequence of SEQ ID NO:63; (3) a heavy chain having the amino acid sequence of SEQ ID NO:64, and a light chain having the amino acid sequence of SEQ ID NO:65; (4) a heavy chain having the amino acid sequence of SEQ ID NO:66, and a light chain having the amino acid sequence of SEQ ID NO:67; (5) a heavy chain having the amino acid sequence of SEQ ID NO:68, and a light chain having the amino acid sequence of SEQ ID NO:69; (6) a heavy chain having the amino acid sequence of SEQ ID NO:70, and a light chain having the amino acid sequence of SEQ ID NO:71; (7) a heavy chain having the amino acid sequence of SEQ ID NO:72, and a light chain having the amino acid sequence of SEQ ID NO:73; (8) a heavy chain having the amino acid sequence of SEQ ID NO:74, and a light chain having the amino acid sequence of SEQ ID NO:75; (9) a heavy chain having the amino acid sequence of SEQ ID NO:76, and a light chain having the amino acid sequence of SEQ ID NO:77; or (10) a heavy chain having the amino acid sequence of SEQ ID NO:78, and a light chain having the amino acid sequence of SEQ ID NO:79.

In one embodiment, the fusion construct of the present disclosure comprises a binding molecule having a LukE binding region coupled to an immunoglobulin heavy chain, where the heavy chain comprises a variable region that binds to a glycosylated staphylococcal surface protein. Exemplary fusion constructs according to this aspect of the present disclosure comprise an amino acid sequence of any one of SEQ ID NOs: 848-851, 900, or 903. In one embodiment, these exemplary fusion constructs further comprise an immunoglobulin light chain variable region. Suitable light chains include, without limitation, light chains having an amino acid sequence of any one of SEQ ID NO: 61, 63, 65 or 67.

In another embodiment, the fusion construct of the present disclosure comprises a binding molecule having a LukE binding region coupled to an immunoglobulin light chain, where the light chain comprises a variable region that binds to a glycosylated staphylococcal surface protein. An exemplary fusion construct according to this aspect comprises an amino acid sequence of SEQ ID NO: 980. In one embodiment, these exemplary fusion constructs further comprise an immunoglobulin heavy chain variable region or heavy chain. Suitable heavy chains include, without limitation, heavy chains having an amino acid sequence of any one of SEQ ID NOs: 60, 62, 64 or 66.

In one embodiment, the fusion construct of the present disclosure comprises a binding molecule having a LukAB binding region coupled to an immunoglobulin heavy chain, where the heavy chain comprises a variable region that binds to a glycosylated staphylococcal surface protein. Exemplary fusion constructs according to this aspect of the present disclosure comprise an amino acid sequence of any one of SEQ ID NOs: 70 and 72. In one embodiment, these exemplary fusion constructs further comprise an immunoglobulin light chain. Suitable light chains include, without limitation, light chains having an amino acid sequence of any one of SEQ ID NO: 61, 63, 65 or 67.

In another embodiment, the fusion construct of the present disclosure comprises a binding molecule having a LukAB binding region coupled to an immunoglobulin light chain, where the light chain comprises a variable region that binds to a glycosylated staphylococcal surface protein. Exemplary fusion constructs according to this aspect of the present disclosure comprise an amino acid sequence of SEQ ID NO: 979. In one embodiment, these exemplary fusion constructs further comprise an immunoglobulin heavy chain variable region or heavy chain. Suitable heavy chains include, without limitation, heavy chains having an amino acid sequence of any one of SEQ ID NO: 60, 62, 64 or 66.

In another embodiment, the fusion construct of the present disclosure comprises a binding molecule having a LukE binding region and a LukAB binding region coupled to an immunoglobulin heavy chain, where the heavy chain comprises a variable region that binds to a glycosylated staphylococcal surface protein. Exemplary fusion constructs according to this aspect of the disclosure comprise an amino acid sequence of any one of SEQ ID NOs: 852-859, 887, 888, 893, 894, 906, 920, 931-956, 961, 976, and 984-988. In one embodiment, these exemplary fusion constructs further comprise an immunoglobulin light chain variable region or light chain comprising a glycosylated staphylococcal surface protein binding domain. Suitable immunoglobulin light chains include, without limitation, light chains having an amino acid sequence of any one of SEQ ID NO: 61, 63, 65 or 67.

Another aspect of the present disclosure is directed to nucleic acid molecules encoding the binding molecules and fusion constructs described herein. The nucleic acid molecules of the present disclosure include isolated polynucleotides, portions of expression vectors or portions of linear DNA sequences, including linear DNA sequences used for in vitro transcription/translation, vectors compatible with prokaryotic, eukaryotic or filamentous phage expression, secretion and/or display of the compositions or directed mutagens thereof.

In one embodiment isolated polynucleotides of the present disclosure include those encoding the binding molecules described supra. Exemplary isolated polynucleotide molecules include those encoding a FN3 domain that comprises a LukE binding region having any one of the amino acid sequences of SEQ ID NOs: 25-59, 113,116-136, 155, 363, 364, 366-369, 375, 376, 388, 586, and 739-839. In another embodiment, exemplary polynucleotides include those encoding a FN3 domain that comprises a LukAB binding region having any one of the amino acid sequences of SEQ ID NOs: 14, 15, 16, 17, 145, 156, 158, 167, 214, 226, 247, 282, 286, 316, 370, 386, 388, 392, 446, 454, 462, 530, 540, 568, 574, 584, 587-666 and 672-738. In another embodiment, exemplary polynucleotides include those encoding a FN3 domain that comprises an Hla binding region having any one of the amino acid sequences of SEQ ID Nos: 1097, 1099, 1112, 1142, and 1100.

In other embodiment, exemplary polynucleotides include isolated polynucleotides encoding the antibody-binding molecule fusion constructs described herein. For example, exemplary isolated polynucleotides include those encoding a fusion construct comprising a binding molecule having a LukE binding domain coupled to an immunoglobulin heavy chain comprising a glycosylated staphylococcal surface protein binding domain (e.g., polynucleotides encoding amino acid sequences of SEQ ID NOs: 848-851, 900 or 903), and a LukE binding domain coupled to an immunoglobulin light chain comprising a glycosylated staphylococcal surface protein binding domain (e.g., a polynucleotide encoding an amino acid sequence of SEQ ID NO: 980). Exemplary isolated polynucleotides also include those encoding a fusion construct comprising a binding molecule having a LukAB binding domain coupled to an immunoglobulin heavy chain comprising a glycosylated staphylococcal surface protein binding domain (e.g., polynucleotides encoding amino acid sequences of SEQ ID NOs: 70 and 72), and a LukAB binding domain coupled to an immunoglobulin light chain comprising a glycosylated staphylococcal surface protein binding domain (e.g., a polynucleotide encoding an amino acid sequence of SEQ ID NO: 979). Exemplary isolated polynucleotides also include those encoding a fusion construct comprising a binding molecule having LukE and LukAB binding domains coupled to a immunoglobulin heavy chain comprising a glycosylated staphylococcal surface protein binding region (e.g., polynucleotides encoding amino acid sequences of SEQ ID NOs: 852-859, 887, 888, 893, 894, 906, 920, 931-956, 961, 976, and 984-988).

The polynucleotides of the disclosure may be produced by chemical synthesis such as solid phase polynucleotide synthesis on an automated polynucleotide synthesizer and assembled into complete single or double stranded molecules. Alternatively, the polynucleotides of the disclosure may be produced by other techniques such a PCR followed by routine cloning. Techniques for producing or obtaining polynucleotides of a given known sequence are well known in the art.

The polynucleotides described herein may comprise at least one non-coding sequence, such as a promoter or enhancer sequence, intron, polyadenylation signal, a cis sequence facilitating RepA binding, and the like. The polynucleotide sequences may also comprise additional sequences encoding additional amino acids that encode for example a marker or a tag sequence such as a histidine tag or an HA tag to facilitate purification or detection of the protein, a signal sequence, a fusion protein partner such as RepA, Fc or bacteriophage coat protein such as pIX or pIII.

Another embodiment of the disclosure is a vector comprising at least one polynucleotides as described herein. Such vectors may be plasmid vectors, viral vectors, vectors for baculovirus expression, transposon based vectors or any other vector suitable for introduction of the polynucleotides of the invention into a given organism or genetic background by any means. Such vectors may be expression vectors comprising nucleic acid sequence elements that can control, regulate, cause or permit expression of a polypeptide encoded by such a vector. Such elements may comprise transcriptional enhancer binding sites, RNA polymerase initiation sites, ribosome binding sites, and other sites that facilitate the expression of encoded polypeptides in a given expression system. Such expression systems may be cell-based, or cell-free systems well known in the art.

Another embodiment of the present disclosure is a host cell comprising the above described vectors. The binding molecules and/or fusion constructs disclosed herein can be optionally produced by a cell line, a mixed cell line, an immortalized cell or clonal population of immortalized cells, as well known in the art (see e.g., Ausubel et al., ed., Current Protocols in Molecular Biology, John Wiley & Sons, Inc., NY, N.Y. (1987-2001); Sambrook et al., Molecular Cloning: A Laboratory Manual, 2$^{nd}$ Edition, Cold Spring Harbor, N.Y. (1989); Harlow and Lane, Antibodies, a Laboratory Manual, Cold Spring Harbor, N.Y. (1989); Colligan et al., eds., Current Protocols in Immunology, John Wiley & Sons, Inc., NY (1994-2001); Colligan et al., Current Protocols in Protein Science, John Wiley & Sons, NY, N.Y., (1997-2001), which are hereby incorporated by reference in their entirety).

The host cell chosen for expression may be of mammalian origin or may be selected from COS-1, COS-7, HEK293, BHK21, CHO, BSC-1, He G2, SP2/0, HeLa, myeloma, lymphoma, yeast, insect or plant cells, or any derivative, immortalized or transformed cell thereof. Alternatively, the host cell may be selected from a species or organism incapable of glycosylating polypeptides, e.g. a prokaryotic cell or organism, such as BL21, BL21(DE3), BL21-GOLD (DE3), XL1-Blue, JM109, HMS174, HMS174(DE3), and any of the natural or engineered *E. coli* spp, *Klebsiella spp.*, or *Pseudomonas* spp strains.

Another aspect of the disclosure is directed to a method of producing and isolating the binding molecules and fusion constructs as described herein. This method involves culturing the isolated host cell of the disclosure under conditions such that the binding molecules or fusion constructs are expressed, and purifying the expressed binding molecules or fusion constructs from the host cell culture.

The binding molecules and fusion constructs described herein can be purified from recombinant cell cultures by well-known methods, for example by protein A purification, ammonium sulfate or ethanol precipitation, acid extraction, anion or cation exchange chromatography, phosphocellulose chromatography, hydrophobic interaction chromatography, affinity chromatography, hydroxylapatite chromatography and lectin chromatography, or high performance liquid chromatography (HPLC).

Purified or isolated binding molecules and fusion constructs as described herein may be linked to one of a variety of non-proteinaceous polymers, e.g., polyethylene glycol, polypropylene glycol, polyoxyalkylenes, or copolymers of polyethylene glycol and polypropylene glycol. The binding molecules and/or fusion constructs may also be entrapped in microcapsules prepared, for example, by coacervation techniques or by interfacial polymerization (for example, hydroxymethylcellulose or gelatine-microcapsules and poly (methylmethacylate) microcapsules, respectively), in colloidal drug delivery systems (for example, liposomes, albumin microspheres, microemulsions, nanoparticles and nanocapsules), or in macroemulsions. Such techniques are disclosed in REMINGTON'S PHARMACEUTICAL SCIENCES, 16th edition, Oslo, A., Ed., (1980), which is hereby incorporated by reference in its entirety.

For therapeutic use, the binding molecules and fusion constructs as described herein may be prepared as pharmaceutical compositions containing an effective amount of the binding molecules as an active ingredient in a pharmaceutically acceptable carrier. The term "carrier" refers to a diluent, adjuvant, excipient, or vehicle with which the active compound is administered. Such vehicles can be liquids, such as water and oils, including those of petroleum, animal, vegetable or synthetic origin, such as peanut oil, soybean oil, mineral oil, sesame oil and the like. For example, 0.4% saline and 0.3% glycine can be used. These solutions are sterile and generally free of particulate matter. They may be sterilized by conventional, well-known sterilization techniques (e.g., filtration). The compositions may contain pharmaceutically acceptable auxiliary substances as required to approximate physiological conditions such as pH adjusting and buffering agents, stabilizing, thickening, lubricating and coloring agents, etc. The concentration of binding molecule or fusion construct as described herein in such pharmaceutical formulation can vary widely, i.e., from less than about 0.5%, usually at or at least about 1% to as much as 15 or 20% by weight and will be selected primarily based on required dose, fluid volumes, viscosities, etc., according to the particular mode of administration selected. Suitable vehicles and formulations, inclusive of other human proteins, e.g., human serum albumin, are described, for example, in e.g. REMINGTON: THE SCIENCE AND PRACTICE OF PHARMACY, 21$^{st}$ Edition, Troy, D. B. ed., Lipincott Williams and Wilkins, 2006, Part 5, Pharmaceutical Manufacturing pp 691-1092, see especially pp. 958-989, which is hereby incorporated by reference in its entirety.

The binding molecules and fusion constructs described herein can be used in non-isolated or isolated form. Furthermore, the binding molecules and fusion constructs hereof can be used alone or in a mixture comprising at least one other binding molecule or fusion construct hereof. In other words, the binding molecules and fusion constructs can be used in combination, e.g., as a pharmaceutical composition comprising two or more binding molecules hereof, two or more fusion constructs, a binding molecule and fusion construct, and variants or fragments thereof. For example, binding molecules and/or fusion constructs having different, but complementary activities can be combined in a single therapy to achieve a desired therapeutic effect, but alternatively, binding molecules and fusion constructs having identical activities can also be combined in a single therapy to achieve a desired prophylactic, therapeutic or diagnostic effect. Optionally, the mixture further comprises at least one other therapeutic agent. In one aspect, the other therapeutic agent may be an anti-infective agent, an antibiotic agent, and/or an antimicrobial agent that is useful in the prophylaxis and/or treatment of a staphylococcal infection. In another aspect, the other therapeutic agent may be any agent that is useful in the prophylaxis and/or treatment of a condition associated with a staphylococcal infection.

The binding molecules, fusion constructs, or pharmaceutical compositions containing the same can be used for the treatment, prevention or amelioration of a staphylococcal infection. The staphylococcal infection may be caused by any *Staphylococcus* spp. In one aspect, the staphylococcal infection is caused by *Staphylococcus aureus*, including methicillin-resistant *S. aureus* (MRSA) and methicillin-sensitive *S. aureus* (MSSA). Accordingly, the present disclosure provides a method for the treatment, prevention or amelioration of a staphylococcal infection that involves administering to a subject in need thereof a binding molecule, fusion construct, or compositions containing the same as described herein.

In accordance with this aspect, the target "subject" encompasses any animal, for example, a mammal, such as a human. In the context of administering a composition of the disclosure for purposes of preventing a staphylococcal infection in a subject, the target subject encompasses any subject that is at risk of becoming infected with *Staphylococcus* or developing a staphylococcal infection. Susceptible subjects include infants and juveniles, as well as immunocompromised juvenile, adults, and elderly adults. However, any infant, juvenile, adult, or elderly adult or immunocompromised individual at risk for developing a staphylococcal infection can be treated in accordance with the methods described herein. In the context of administering a composition of the disclosure for purposes of treating a staphylococcal infection in a subject, the target subject encompasses any subject infected with *Staphylococcus*. Particularly suitable subjects include those at risk of infection, susceptible to infection, or those infected with methicillin-resistant *S. aureus* (MRSA) or methicillin sensitive *S. aureus* (MSSA). Other suitable subjects include those subjects which may have or are at risk for developing a condition resulting from a *Staphylococcus* infection, i.e., a staphylococcal associated condition, such as, for example, skin wounds and infections, tissue abscesses, folliculitis, osteomyelitis, pneumonia, scalded skin syndrome, septicemia, septic arthritis, myocarditis, endocarditis, and toxic shock syndrome.

In one embodiment, the binding molecules, fusion constructs, or pharmaceutical compositions containing the same are administered prophylactically to prevent, delay, or inhibit the development of staphylococcal infection in a subject at risk of developing a staphylococcal infection or associated condition. In one aspect, prophylactic administration of one or more binding molecules described herein is effective to fully prevent *S. aureus* infection in an individual. In other embodiments, prophylactic administration is effective to prevent the full extent of infection that would otherwise develop in the absence of such administration, i.e., substantially prevent, inhibit, or minimize staphylococcal infection in an individual.

In another embodiment, the binding molecules, fusion constructs, or pharmaceutical compositions as described herein are administered therapeutically to an individual having a staphylococcal infection to inhibit the progression and further development of the infection, i.e., to inhibit and/or prevent the spread of the infection to other cells in an individual, decrease infection, and to treat or alleviate one or more symptoms of infection.

Therapeutically effective amounts of the binding molecules and fusion constructs described herein are determined in accordance with standard procedures, which take numerous factors into account, including, for example, the concentrations of the binding molecules or fusion constructs in a pharmaceutical composition, the mode and frequency of administration, the severity of the *Staphylococcus* infection to be treated (or prevented), and subject details, such as age, weight and overall health and immune condition. General guidance can be found, for example, in the publications of the International Conference on Harmonization and in REMINGTON'S PHARMACEUTICAL SCIENCES (Mack Publishing Company 1990), which is hereby incorporated by reference in its entirety. A clinician may administer a composition comprising the binding molecules or fusion constructs described herein in a single dose or in accordance with a multi-dosing protocol until a dosage is reached that provides the desired or required prophylactic or therapeutic effect. The progress of this therapy can be easily monitored by conventional assays. In prophylactic applications, a relatively low dosage is administered at relatively infrequent intervals over a long period of time. In therapeutic applications, a relatively high dosage at relatively short intervals (e.g., as little as 15 minutes, 30 minutes, 60 minutes, 90 minutes or even 2 or 3 hours) is sometimes required until progression of the disease is reduced or terminated, and preferably until the subject shows partial or complete amelioration of symptoms of disease.

The therapeutically effective amount, i.e., the dosage sufficient for a subject having a staphylococcal infection that is sufficient to slow or prevent the spread or severity of staphylococcal infection, and/or the dosage sufficient to prevent, alleviate (either partially or completely) a staphylococcal infection associated condition. Such therapeutically effective amounts vary by individual, but may range from 0.1 to 10 mg/kg body weight, for example 1, 2, 3, 4, 5, 6, 7, 8, 9 or 10 mg/kg, but may even higher, for example 15, 20, 30, 40, 50, 60, 70, 80, 90 or 100 mg/kg. A fixed unit dose may also be given, for example, 50, 100, 200, 500 or 1000 mg, or the dose may be based on the patient's surface area, e.g., 400, 300, 250, 200, or 100 mg/m². Usually between 1 and 8 doses, (e.g., 1, 2, 3, 4, 5, 6, 7 or 8) may be administered to treat infection, but 10, 12, 20 or more doses may be given depending on the severity of infection. Administration of binding molecules or fusion constructs of the present disclosure may be repeated after one day, two days, three days, four days, five days, six days, one week, two weeks, three weeks, one month, five weeks, six weeks, seven weeks, two months, three months, four months, five months, six months or longer. Repeated courses of treatment are also possible, as is chronic administration. The repeated administration may be at the same dose or at a different dose.

The therapeutic compositions of the present disclosure can be administered alone or as part of a combination therapy in conjunction with one or more other active agents, depending upon the nature of the *Staphylococcus* infection that is being treated. Such additional active agents include anti-infective agents, antibiotic agents, and antimicrobial agents that are readily known in the art.

The mode of administration of the binding molecules, fusion constructs, and pharmaceutical compositions described herein may be any suitable route that delivers the binding molecule(s) or fusion construct(s) to the host, such as parenteral administration, e.g., intradermal, intramuscular, intraperitoneal, intravenous or subcutaneous, pulmonary; transmucosal (oral, intranasal, intravaginal, rectal); using a formulation in a tablet, capsule, solution, powder, gel, particle; and contained in a syringe, an implanted device, osmotic pump, cartridge, micropump; or other means appreciated by the skilled artisan, as well known in the art. Site specific administration may be achieved by, for example, intrarticular, intrabronchial, intraabdominal, intracapsular, intracartilaginous, intracavitary, intracelial, intracerebellar, intracerebroventricular, intracolic, intracervical, intragastric, intrahepatic, intracardial, intraosteal, intrapelvic, intrapericardiac, intraperitoneal, intrapleural, intraprostatic, intrapulmonary, intrarectal, intrarenal, intraretinal, intraspinal, intrasynovial, intrathoracic, intrauterine, intravascular, intravesical, intralesional, vaginal, rectal, buccal, sublingual, intranasal, or transdermal delivery.

The binding molecules and fusion constructs provided herein can also be used in methods for diagnosing a staphylococcal infection in a subject. In one aspect, the method for diagnosing a staphylococcal infection involves contacting a binding molecule or fusion construct as described herein with a sample from the subject to be diagnosed, and detecting at least the presence or the absence of one or more staphylococcal leukotoxins in the sample. In another aspect, the method for diagnosing a staphylococcal infection involves contacting a binding molecule or fusion construct as described herein with a sample from the subject to be diagnosed, and detecting the presence or the absence of one or more staphylococcal leukotoxins in the sample and the presence or absence of one or more other staphylococcal proteins, such as, e.g., a glycosylated staphylococcal surface protein. A staphylococcal infection is diagnosed in the subject based on this detection. In other words, the detection of the one or more staphylococcal leukotoxins alone or in combination with another staphylococcal protein indicates a positive diagnosis of a staphylococcal infection.

In accordance with this aspect, the sample from the subject may comprise a blood, tissue, cell, serum, or any other biological sample.

Another aspect relates to a method for the detection of a staphylococcal infection in a sample. This method involves contacting the binding molecule or fusion construct as described herein with a sample, and detecting the presence or the absence of a at least one or more staphylococcal leukotoxins. Optionally, the presence or absence of one or more staphylococcal leukotoxins and one or more additional staphylococcal proteins, e.g., glycosylated staphylococcal surface proteins, can be detected using one or more of the fusion constructs described herein. Detection of the one or more staphylococcal leukotoxins alone or in combination with another staphylococcal protein indicates the presence of *Staphylococcus* in the sample. In accordance with this aspect, the sample may be any biological sample obtained from the environment, an animal, or a human.

Methods described herein involving the detection of a staphylococcal leukotoxin alone or in combination with another staphylococcal protein in a sample from a subject or elsewhere involve the use of a detectably labeled binding molecule or fusion construct. Accordingly, in one aspect the binding molecule or fusion construct as described herein may be coupled to a detectable label. Suitable detectable labels are well known in the art and include detectable tags (e.g., a poly-histidine (His$_6$) tag, a glutathione-S-transferase (GST-) tag, or a maltose-binding protein (MBP-) tag);

radioactive labels (e.g., carbon ($^{14}$C) or phosphorous ($^{32}$P)); fluorescent labels (e.g., fluorescein and derivatives thereof, fluorescein isothiocyanate, rhodamine and derivatives thereof, dichlorotriazinylamine fluorescein, dansyl chloride or phycoerythrin); luminescent labels (e.g., luminol); bioluminescent labels (e.g., luciferase, luciferin, and aequorin); or enzymatic labels (e.g., luciferin, 2,3-dihydrophthalazinediones, malate dehydrogenase, urease, peroxidases (e.g., horseradish peroxidase), alkaline phosphatase, β-galactosidase, glucoamylase, lysozyme, saccharide oxidases (e.g., glucose oxidase, galactose oxidase, and glucose-6-phosphate dehydrogenase), heterocyclic oxidases (e.g., uricase and xanthine oxidase), lactoperoxidase, microperoxidase). Alternatively, the binding molecule can be bound by a detectable label, for example, bound by a secondary antibody that contains a detectable label.

Detection assays for detecting the labeled binding molecule or fusion construct bound to a staphylococcal leukotoxin and/or another staphylococcal protein in a sample are well known in the art and include, for example, immunoprecipitation, enzyme-linked immunosorbent assay (ELISA), radioimmunoassay (RIA), or fluorescent activated cell sorting (FACS).

Furthermore, the binding molecules and fusion constructs of the present disclosure can be used for the prevention of a staphylococcal infection. This method involves contacting the binding molecule or fusion construct as described herein with a sample from a subject, and detecting a staphylococcal leukotoxin and/or another staphylococcal protein, e.g., a glycosylated staphylococcal surface protein as a result of the contacting. If a staphylococcal leukotoxin and/or another staphylococcal protein is detected in the subject sample, then an agent suitable for preventing staphylococcal infection is administered to the subject. Exemplary prophylactic agents include, but are not limited to, the binding molecules described herein, one or more antibiotics (e.g., mupirocin, nafcillin, cefazolin, dicloxacillin, clindamycin, vancomycin, linezolid, rifampin, sulfamethoxazole-trimethoprim), and/or other anti-infective agents that are effective against staphylococcal infection.

Another aspect of the present disclosure is directed to Leukocidin B (LukB) and Leukocidin A (LukA) polypeptides comprising stem domain mutations and/or deletions. The stem domains of the bi-component leukocidins are structural domains involved in the formation of the active oligomeric, pore forms of the toxins that pierce the host cell membrane and cause cell death via osmotic lysis. As demonstrated in the Examples herein, the stem domain variants of LukA and LukB retain the neutralizing epitope recognized by the LukAB binding molecule (Luk17) described herein. Accordingly, since the stem domain variants do not exhibit cytolytic activity, yet present a neutralizing epitope, they make ideal components of a S. aureus vaccine composition.

In one embodiment, the recombinant LukB polypeptide stem domain variant comprises an amino acid sequence corresponding to amino acid residues 1-109 of SEQ ID NO: 1026 coupled to amino acid residues 152-305 of SEQ ID NO: 1026. The LukB polypeptide does not comprise one or more amino acid residues corresponding to amino acid residues 110-151 of SEQ ID NO: 1026. In other words, one or more amino acid residues corresponding to amino acid residues 110-151 of SEQ ID NO: 1026 is deleted or mutated, thereby rendering the stem domain of the LukB polypeptide inactive or non-functional. When two or more amino acid residues are deleted or mutated, the two or more amino acid residues may be contiguous or non-contiguous. For example, 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, or 42 contiguous or non-contiguous amino acid residues within the stretch of amino acid residues corresponding to 110-151 of SEQ ID NO: 1026 are deleted or mutated in the LukB polypeptide as described herein. In one embodiment, the LukB polypeptide comprises a deletion of amino acid residues corresponding to amino acid residues 122-126 of SEQ ID NO: 1026. In another embodiment, the LukB polypeptide comprises a deletion of amino acid residues corresponding to amino acid residues 130-134 of SEQ ID NO: 1026. In another embodiment, the LukB polypeptide comprises a deletion of amino acid residues corresponding to amino acid residues 108-150 of SEQ ID NO: 1026. In another embodiment, the LukB polypeptide comprises a deletion of amino acid residues corresponding to amino acid residues 110-150 of SEQ ID NO: 1026. In another embodiment, the LukB polypeptide comprises a deletion of amino acid residues corresponding to amino acid residues 110-151 of SEQ ID NO: 1026. The remaining portions of the LukB polypeptide, e.g., amino acid residues corresponding to and comprising residues 1-109 of SEQ ID NO: 1026 and 152-305 of SEQ ID NO: 1026 can be coupled directly or via a short linker. Suitable linkers include, without limitation, glycine-rich (e.g. $G_{3-5}$) or glycine/serine-rich (e.g. GSG, GSGS, $(SGG)_2$, $GS_NG$) linker sequences.

Exemplary LukB polypeptides in accordance with this aspect of the disclosure include, without limitation, LukB polypeptides comprising an amino acid sequence of SEQ ID NO: 1029, SEQ ID NO: 1030, SEQ ID NO: 1031, SEQ ID NO: 1032, SEQ ID NO: 1150, or SEQ ID NO: 1151.

The recombinant Leukocidin A (LukA) polypeptide stem domain variant comprises an amino acid sequence corresponding to amino acid residues 1-134 of SEQ ID NO: 1018 coupled to amino acid residues 175-324 of SEQ ID NO: 1018. The LukA polypeptide does not comprise one or more amino acid residues corresponding to amino acid residues 135-174 of SEQ ID NO: 1018. In other words, one or more amino acid residues corresponding to amino acid residues 135-174 of SEQ ID NO: 1018 is deleted or mutated, thereby rendering the stem domain of the LukA polypeptide inactive or non-functional. When two or more amino acid residues are mutated or deleted, the two or more amino acid residues may be contiguous or non-contiguous. For example, 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, or 40 contiguous or non-contiguous amino acid residues within the stretch of amino acid residues corresponding to 135-174 of SEQ ID NO: 1018 are deleted or mutated in the LukA polypeptide as described herein. In one embodiment, the LukA polypeptide comprises a deletion of amino acid residues corresponding to amino acid residues 144-149 of SEQ ID NO: 1018. In another embodiment, the LukA polypeptide comprises a deletion of amino acid residues corresponding to amino acid residues 135-174 of SEQ ID NO: 1018. The remaining portions of the LukA polypeptide, i.e., amino acid residues corresponding to residues 1-134 or SEQ ID NO: 1018 and 175-324 of SEQ ID NO: 1018 can be coupled directly or via a suitable linker. Suitable linkers include, without limitation, glycine-rich (e.g. $G_{3-5}$) or glycine/serine-rich (e.g. GSG, GSGS, $(SGG)_2$, $GS_NG$) linker sequences.

The recombinant LukA polypeptide as described herein may further comprise a glutamic acid to alanine substitution at the amino acid residue corresponding to amino acid residue 323 of SEQ ID NO: 1018 (DuMont et al., "Identification of a Crucial Residue Required for *Staphylococcus aureus* LukAB Cytotoxicity and Receptor Recognition," *Infect Immun*. 82(3):1268-76 (2014), which is hereby incorporated by reference in its entirety).

Exemplary LukA polypeptides in accordance with this aspect of the disclosure include, without limitation, LukA polypeptides comprising an amino acid sequence of SEQ ID NO: 1022, SEQ ID NO: 1023, SEQ ID NO: 1024, SEQ ID NO: 1025, or SEQ ID NO: 1149.

Another aspect of the present disclosure is directed to a vaccine composition comprising the LukB and LukA stem domain variants as described supra. In other words, the vaccine composition comprises a recombinant Leukocidin B (LukB) polypeptide comprising an amino acid sequence corresponding to amino acid residues 1-109 of SEQ ID NO: 1026 coupled to amino acid residues 152-305 of SEQ ID NO: 1026, wherein said LukB polypeptide does not comprise one or more amino acid residues corresponding to amino acid residues 110-151 of SEQ ID NO: 1026. The vaccine composition further comprises a recombinant Leukocidin A (LukA) polypeptide comprising an amino acid sequence corresponding to amino acid residues 1-134 of SEQ ID NO: 1018 coupled to amino acid residues 177-324 of SEQ ID NO: 1018, wherein said LukA polypeptide does not comprise one or more amino acid residues corresponding to amino acid residues 135-174 of SEQ ID NO: 1018. Exemplary LukB and LukA stem domain variants are described supra.

The vaccine composition may further comprise one or more adjuvants. Suitable adjuvants are known in the art and include, without limitation, flagellin, Freund's complete or incomplete adjuvant, aluminum hydroxide, lysolecithin, pluronic polyols, polyanions, peptides, oil emulsion, dinitrophenol, iscomatrix, and liposome polycation DNA particles.

The vaccine composition as described herein may be prepared by formulating the recombinantly produced LukA and LukB stem domain variants with a pharmaceutically acceptable carrier and optionally a pharmaceutically acceptable excipient. As used herein, the terms "pharmaceutically acceptable carrier" and "pharmaceutically acceptable excipient" (e.g., additives such as diluents, immunostimulants, adjuvants, antioxidants, preservatives and solubilizing agents) are nontoxic to the cell or mammal being exposed thereto at the dosages and concentrations employed. Examples of pharmaceutically acceptable carriers include water, e.g., buffered with phosphate, citrate and another organic acid. Representative examples of pharmaceutically acceptable excipients that may be useful include antioxidants such as ascorbic acid; low molecular weight (less than about 10 residues) polypeptides; proteins, such as serum albumin, gelatin, or immunoglobulins; adjuvants; hydrophilic polymers such as polyvinylpyrrolidone; amino acids such as glycine, glutamine, asparagine, arginine or lysine; monosaccharides, disaccharides, and other carbohydrates including glucose, mannose, or dextrins; chelating agents such as EDTA; sugar alcohols such as mannitol or sorbitol; salt forming counterions such as sodium; and/or nonionic surfactants such as TWEEN®, polyethylene glycol (PEG), and PLURONICS®.

Another aspect of the present disclosure relates to a method of immunizing a subject against a *Staphylococcus aureus* infection. This method involves administering the vaccine composition comprising the LukA and LukB stem domain variants, in an amount effective to immunize against *S. aureus* infection in the subject. A suitable subject for treatment in accordance with this aspect of the present invention is a subject at risk of developing a *S. aureus* infection.

In accordance with this aspect, a therapeutically effective amount of the vaccine composition for administration to a subject to immunize against *S. aureus* infection is the amount necessary to generate a humoral (i.e., antibody mediated) immune response. The generated humoral response is sufficient to prevent or at least reduce the extent of *S. aureus* infection that would otherwise develop in the absence of such response. Preferably, administration of a therapeutically effective amount of the vaccine composition described herein induces a neutralizing immune response against *S. aureus* in the subject. To effectuate an effective immune response in a subject, the composition may further contain one or more additional *S. aureus* antigens or an adjuvant as described supra. In an alternative embodiment, the adjuvant is administered separately from the composition to the subject, either before, after, or concurrent with administration of the composition of the present invention.

For purposes of this aspect the disclosure, the target "subject" encompasses any animal, preferably a mammal, more preferably a human. In the context of administering a vaccine composition for purposes of preventing a *S. aureus* infection in a subject, the target subject encompasses any subject that is at risk of being infected by *S. aureus*. Particularly susceptible subjects include infants and juveniles, as well as immunocompromised juvenile, adults, and elderly adults. However, any infant, juvenile, adult, or elderly adult or immunocompromised individual at risk for *S. aureus* infection can be treated in accordance with the methods and vaccine composition described herein. Particularly suitable subjects include those at risk of infection with methicillin-resistant *S. aureus* (MRSA) or methicillin sensitive *S. aureus* (MSSA).

Therapeutically effective amounts of the vaccine composition comprising LukA and LukB for immunization will depend on whether an adjuvant is co-administered, with higher dosages being required in the absence of adjuvant. The amount of LukAB for administration sometimes varies from 1 µg-500 µg per patient and more usually from 5-500 µg per injection for human administration. Occasionally, a higher dose of 1-2 mg per injection is used. Typically about 10, 20, 50 or 100 µg is used for each human injection. The timing of injections can vary significantly from once a day, to once a year, to once a decade. Generally an effective dosage can be monitored by obtaining a fluid sample from the subject, generally a blood serum sample, and determining the titer of antibody developed against LukAB, using methods well known in the art and readily adaptable to the specific antigen to be measured. Ideally, a sample is taken prior to initial dosing and subsequent samples are taken and titered after each immunization. Generally, a dose or dosing schedule which provides a detectable titer at least four times greater than control or "background" levels at a serum dilution of 1:100 is desirable, where background is defined relative to a control serum or relative to a plate background in ELISA assays.

EXAMPLES

Examples are provided below to illustrate the present disclosure. These examples are not meant to constrain the present disclosure to any particular application or theory of operation.

Example 1: Definition of a Minimal Epitope Target for mAb 5133 and mAb 5133-Based Fusion Proteins The specificity of mAb 5133 for glycosylated forms of recombinant variants of the *S. aureus* SdrC protein, a member of the Serine-Aspartate Repeat (SDR) family, was previously demonstrated in a series of western blot analyses (PCT Application Publication No. WO2015089073 to Torres et al., which is hereby incorporated by reference in its entirety). Specifically, following incubation of purified, recombinant SdrC proteins with whole cell lysates prepared from *S. aureus* strain JE2 (Fey et al., "A Genetic Resource for Rapid and Comprehensive Phenotype Screening of Nonessential *Staphylococcus aureus* Genes," *mBio* 4(1):e00537-12 (2013), which is hereby incorporated by reference in its entirety), specific protein bands were detected via western blot in contrast to those detected following incubation with lysates prepared from *S. aureus* NE105, an otherwise-isogenic derivative of JE2 that lacks expression of the SdgB glycosyltransferase (PCT Application Publication No. WO2015089073 to Torres et al., which is hereby incorporated by reference). Further, incubation of purified, recombinant SdrC proteins with a recombinant form of the SdgB glycosyltransferase similarly yielded the mAb 5133 specific epitope in a manner that was dependent on the presence of uridine diphosphate N-acetylglucosamine (UDP-GlcNac) (PCT Application Publication No. WO2015089073 to Torres et al., which is hereby incorporated by reference). In order to further define a minimal epitope for mAb 5133, a synthetic peptide was employed as an in vitro substrate for the SdgB glycosyltransferase that contains ten (10) copies of the Serine-Aspartate dipeptide sequence but lacks any additional protein sequence derived from any of the five members of the SDR family of proteins of *S. aureus* (Cheng et al., "Variation of Serine-Aspartate Repeats in Membrane Proteins Possibly Contributes to Staphylococcal Microevolution," *PLoS ONE* 7(4): e34756 (2012); Becherelli et al., "Protective Activity of the CnaBE3 Domain Conserved Among *Staphylococcus aureus* Sdr Proteins," *PLoS One* 8(9): e74718 (2013), which are hereby incorporated by reference in their entirety).

Procedure. Recombinant variants of the *S. aureus* SDR family members Clumping Factor A (ClfA) and Clumping Factor B (ClfB) were engineered in vector pET29a(+) such that each bears an amino-terminal S-tag (Merck KGaA; Raines et al., "The S-Tag Fusion System for Protein Purification," *Methods Enzymol.* 326:362-367 (2000), which is hereby incorporated by reference in its entirety), thrombin cleavage site, a carboxyl-terminal poly-histidine affinity tag, and correspond to SEQ ID NOs: 668 and 669, respectively. These recombinant proteins were purified to apparent homogeneity following inducible over-expression in *Escherichia coli* and purification via Ni-NTA agarose resin (Qiagen 1018244) plus S•Tag™ Thrombin Purification Kit (EMD Millipore 69232). A recombinant form of the *S. aureus* SdgB glycosyltransferase bearing a C-terminal poly-histidine $(His)_6$ affinity tag (SEQ ID NO: 99) was similarly expressed in *E. coli* and purified via Ni-NTA affinity chromatography. For in vitro glycosylation reactions, 100 g of recombinant SDR proteins [SdrC4/SEQ ID NO: 100, ClfA/SEQ ID NO: 668 and ClfB/SEQ ID NO: 669) were incubated +/−30 μg of Uridine diphosphate N-acetylglucosamine (UDP-GlcNac), +/−4 μg of recombinant SdgB/SEQ ID NO:99 in a final volume of 100 μl 100 mM Tris pH 7.5 or 100 μl 100 mM Tris pH 7.5 plus 10% glycerol at 37 C.° for 1 hour. High binding 96-well ELISA plates (Nunc) were coated with recombinant proteins SDR proteins +/− SdgB-mediated glycosylation at 5 μg/mL in PBS and incubated overnight at 4° C. Plates were washed three times with ELISA wash buffer (0.15M NaCl, 0.02% Tween-20) and blocked with blocking buffer (Superblock Thermo 37515) for one hour at ambient temperature. In separate dilution plates, test articles were serially diluted three-fold in blocking buffer starting at 1 μM or 10 μM. ELISA plates were washed three times with ELISA wash buffer and antibody dilutions were transferred from the dilution plates to the ELISA plates and incubated for one hour at ambient temperature. ELISA plates were washed three times with ELISA wash buffer and a secondary goat anti-human Fc gamma-specific-HRP (Jackson Immunoresearch 109-035-098) was diluted 1:10,000 in blocking buffer and added to the plates. Plates were incubated with secondary antibody for one hour at ambient temperature then washed four times with ELISA wash buffer. POD Chemiluminescence substrate (Roche-cat#11582950001) was then added to the plates and absorbance was read immediately on the Perkin Elmer EnVision Multilabel Reader at 405 nm. The data were analyzed using GraphPad Prism. Values were transformed to a log scale and fit using a non-linear regression sigmoidal dose-response equation resulting in an eleven point binding curve for each antibody against each antigen.

For peptide studies, a twenty eight (28) residue peptide of the amino acid sequence: (N-terminus)-SDSDSDSDSDSDSDSDSDSDHHHHHHHH-(C-terminus) (SEQ ID NO: 670) was synthesized (New England Peptide, Inc., Gardner, Mass.). The peptide contains ten copies of the SD dipeptide repeat element followed by an eight residue poly-Histidine sequence and was additionally modified such as to bear an amino-terminal biotin moiety. This peptide is herein referred to as the "SD peptide" and has a measured molecular weight of 3475 Daltons. For in vitro glycosylation reactions, 100 g of the SD peptide was incubated with 4 μg of recombinant SdgB protein in 100 μl of 100 mM Tris pH 7.5 containing 10% glycerol and 30 μg of uridine diphosphate N-acetylglucosamine (UDP-GlcNac) at 37 C.° for 1 hour. Analysis of the extent of in vitro glycosylation was determined by matrix-assisted laser desorption/ionization (MALDI) analysis. The binding of mAb 5133 and mAb 5133-based fusion proteins to the SD peptide (+/− glycosylation) was determined using a plate-based ELISA format wherein the SD peptide (+/− glycosylation) was captured on high binding 96-well ELISA plates (Nunc) coated with streptavidin at 5 μg/mL in PBS and incubated overnight at 4° C. Detection of bound test articles was performed using an HRP-conjugated F(ab')2 fragment donkey anti-human IgG (H+L) (Jackson Immunoresearch 709-006-149 lot 112932) and detection of streptavidin plate-bound SD peptide (+/− glycosylation) by use of an HRP-conjugated anti-polyhistidine antibody (R&D Systems MAB050H polyhistidine HRP MAb Clone AD1.1.10). POD Chemiluminescence substrate (Roche-cat#11582950001) was then added to the plates and absorbance was read immediately on the Perkin Elmer EnVision Multilabel Reader at 405 nm. The data were analyzed using GraphPad Prism. Values were transformed to a log scale and fit using a non-linear regression sigmoidal dose-response equation resulting in an eleven point binding curve for each antibody against the SD peptide (+/− glycosylation) antigen.

Results.

FIG. 1 shows the binding of mAb 5133 (Table 1: Construct 1) to recombinant *S. aureus* SDR proteins +/− SdgB-mediated glycosylation as determined by ELISA assay. FIG. 1A shows specific binding of mAb 5133 to the SdgB glycosylated form of SdrC4 (SEQ ID NO: 100) as previously reported based on western blot analyses (PCT Application Publication No. WO2015089073 to Torres et al., which is hereby incorporated by reference). Similarly, FIGS. 1B and 1C show specific binding of mAb 5133 to the SdgB glycosylated forms of two additional *S. aureus* SDR proteins, ClfA (SEQ ID NO: 668) (FIG. 1B) and ClfB (SEQ ID NO: 669) (FIG. 1C) with no apparent binding to the purified, recombinant proteins as prepared from *E. coli*. These data further substantiate that the antigen epitope recognized by mAb 5133 is a specifically glycosylated form of the SDR proteins as generated by incubation of the proteins in the presence of SdgB and UDP-GlcNac.

MALDI analysis of in vitro SdgB-mediated glycosylation of the SD peptide revealed a series of discrete species that differ by ~203 Daltons indicative of the addition of individual GlcNac units to Serine residues with up to ten apparent sites of glycosylation per monomer peptide. As shown in FIG. 1D, mAb 5133 recognizes streptavidin-bound SD peptide in a concentration-dependent manner that is wholly dependent on prior glycosylation by the SdgB enzyme. FIG. 1E serves as a control to show that equivalent amounts of the glycosylated and non-glycosylated forms of the SD peptide are bound to the streptavidin-coated plates when detected using a HRP-conjugated anti-polyhistidine antibody. FIG. 1F shows the binding of a series of mAb 5133-based fusion proteins to the SdgB glycosylated SD peptide immobilized on plates via streptavidin capture. Importantly, these data indicate that the fusion of dual, tandem FN3 domains (Table 1: Constructs 11, 12, 13 & 14) to the carboxyl-terminus of the heavy chain portion of the parental mAb sequences does not have any detectable impact on the affinity of the test articles for the glycosylated SD peptide antigen as mediated by the mAb 5133 derived V-region. Further, elimination of Protein-A binding of mAb-FN3 fusion proteins (as conferred by introduction of CH3 mutations H435R/Y436F) has no detectable impact on the affinity of the test articles for the glycosylated SD peptide antigen (Table 1: Constructs 11 & 12).

Summary.

These data indicate (i) that the epitope target of mAb 5133 and mAb 5133-FN3 fusion proteins can be defined minimally as a peptide sequence containing as few as ten copies of the SD repeat sequence that has been modified by the *S. aureus* SdgB glycosyltransferase in the presence of UDP-GlcNac, and (ii) that no other sequences from the SdrC protein, or other *S. aureus* SDR family members [Clumping Factor A (ClfA), Clumping Factor B (ClfB), SdrD or SdrE], are necessary components of the minimal antigen epitope recognized by mAb 5133.

TABLE 1

Characteristics of Antibody and Antibody-FN3 Fusion Constructs

| Construct No. | SEQ ID NO: | Description | V-region | Heavy Chain | Heavy Chain FN3 domains | Light Chain FN3 domains |
|---|---|---|---|---|---|---|
| 1 | 60 HC 61 LC | CR5133 | anti-glycosylated SDR-containing proteins | IgG1 wt | none | none |
| 2 | 62 HC 63 LC | CR5133 PRASA | anti-glycosylated SDR-containing proteins | E223P/ L234V/ L235A (G236-deleted) S239D/ K326A/ E333A | none | none |
| 3 | 64 HC 65 LC | CR5133 A6 | anti-glycosylated SDR-containing proteins | H435R/ Y436F | none | none |
| 4 | 66 HC 67 LC | CR5133 PRASA A6 | anti-glycosylated SDR-containing proteins | E223P/ L234V/ L235A (G236-deleted) S239D/ K326A/ E333A/ H435R/ Y436F | none | none |
| 5 | 68 HC 69 LC | CR5133 PRASA A6 LC-L4-D | anti-glycosylated SDR-containing proteins | E223P/ L234V/ L235A (G236-deleted) S239D/ K326A/ E333A/ H435R/ Y436F | none | anti-LukD |
| 6 | 70 HC 71 LC | CR5133 PRASA A6 HC-L4-AB | anti-glycosylated SDR-containing proteins | E223P/ L234V/ L235A (G236-deleted) S239D/ K326A/ E333A/ | anti-LukAB | none |

TABLE 1-continued

Characteristics of Antibody and Antibody-FN3 Fusion Constructs

| Construct No. | SEQ ID NO: | Description | V-region | Heavy Chain | Heavy Chain FN3 domains | Light Chain FN3 domains |
|---|---|---|---|---|---|---|
| 7 | 72 HC 73 LC | CR5133 PRASA A6 LC-L4-D HC-L4-AB | anti-glycosylated SDR-containing proteins | H435R/ Y436F E223P/ L234V/ L235A (G236-deleted) S239D/ K326A/ E333A/ H435R/ Y436F | anti-LukAB | anti-LukD |
| 8 | 74 HC 75 LC | CR5133 PRASA A6 HC-L4-D | anti-glycosylated SDR-containing proteins | E223P/ L234V/ L235A (G236-deleted) S239D/ K326A/ E333A/ H435R/ Y436F | anti-LukD | none |
| 9 | 76 HC 77 LC | CR5133 PRASA A6 HC L4-AB-L4-D | anti-glycosylated SDR-containing proteins | E223P/ L234V/ L235A (G236-deleted) S239D/ K326A/ E333A/ H435R/ Y436F | anti-LukAB anti-LukD | none |
| 10 | 78 HC 79 LC | CR5133 PRASA A6 HC L4-D-L4-AB | anti-glycosylated SDR-containing proteins | E223P/ L234V/ L235A (G236-deleted) S239D/ K326A/ E333A/ H435R/ Y436F | anti-LukD anti-LukAB | none |
| 11 | 856 HC 67 LC | CR5133 PRASA A6 HC-L4-E-L4-AB | anti-glycosylated SDR-containing proteins | E223P/ L234V/ L235A (G236-deleted) S239D/ K326A/ E333A/ H435R/ Y436F | anti-LukE anti-LukAB | none |
| 12 | 952 HC 67 LC | CR5133 PRASA A6 HC-L4-E-L1-AB | anti-glycosylated SDR-containing proteins | E223P/ L234V/ L235A (G236-deleted) S239D/ K326A/ E333A/ H435R/ Y436F | anti-LukE anti-LukAB | none |
| 13 | 965 HC 63 LC | CR5133 PRASA HC-L4-E-L1-AB-FLAG | anti-glycosylated SDR-containing proteins | E223P/ L234V/ L235A (G236-deleted) S239D/ K326A/ E333A/ H435R/ Y436F | anti-LukE anti-LukAB | none |
| 14 | 970 HC 63 LC | CR5133 PRASA HC-L4-E-L4-AB-FLAG | anti-glycosylated SDR-containing proteins | E223P/ L234V/ L235A (G236-deleted) S239D/ K326A/ E333A/ H435R/ Y436F | anti-LukE anti-LukAB | none |

TABLE 1-continued

Characteristics of Antibody and Antibody-FN3 Fusion Constructs

| Construct No. | SEQ ID NO: | Description | V-region | Heavy Chain | Heavy Chain FN3 domains | Light Chain FN3 domains |
|---|---|---|---|---|---|---|
| 15 | 848 HC 71 LC | CR5133 PRASA A6 HC-L4-E | anti-glycosylated SDR-containing proteins | E223P/ L234V/ L235A (G236-deleted) S239D/ K326A/ E333A/ H435R/ Y436F | anti-LukE | none |
| 16 | 868 HC 841 LC | ProA3 PRASA A6 HC-L4-E-L4-AB | anti-Protein A | E223P/ L234V/ L235A (G236-deleted) S239D/ K326A/ E333A/ H435R/ Y436F | anti-LukE anti-LukAB | none |
| 17 | 880 HC 842 LC | ProA9 PRASA A6 HC-L4-E-L4-AB | anti-Protein A | E223P/ L234V/ L235A (G236-deleted) S239D/ K326A/ E333A/ H435R/ Y436F | anti-LukE anti-LukAB | none |
| 18 | 921 HC 844 LC | IsdB PRASA A6 HC-L4-E-L4-AB | anti-IsdB (CSD7) | E223P/ L234V/ L235A (G236-deleted) S239D/ K326A/ E333A/ H435R/ Y436F | anti-LukE anti-LukAB | none |
| 19 | 925 HC 846 LC | LTA PRASA A6 HC-L4-E-L4-AB | anti-LTA (Pagibaximab) | E223P/ L234V/ L235A (G236-deleted) S239D/ K326A/ E333A/ H435R/ Y436F | anti-LukE anti-LukAB | none |
| 20 | 927 HC 843 LC | RSV PRASA A6 HC-L4-E-L4-AB | anti-RSV (CNTO3930) | E223P/ L234V/ L235A (G236-deleted) S239D/ K326A/ E333A/ H435R/ Y436F | anti-LukE anti-LukAB | none |
| 21 | 104 HC 105 LC | CNTO3930 | anti-RSV (CNTO3930) | IgG1 wt | none | none |
| 22 | 887 HC 71 LC | CR5133 PRASA HC-L4-E-L4-AB | anti-glycosylated SDR-containing proteins | E223P/ L234V/ L235A (G236-deleted) S239D/ K326A/ E333A | anti-LukE anti-LukAB | none |
| 23 | 923 HC 845 LC | CR6526 PRASA A6 HC-L4-E-L4-AB | Unknown | E223P/ L234V/ L235A (G236-deleted) S239D/ K326A/ E333A/ H435R/ Y436F | anti-LukE anti-LukAB | none |

TABLE 1-continued

Characteristics of Antibody and Antibody-FN3 Fusion Constructs

| Construct No. | SEQ ID NO: | Description | V-region | Heavy Chain | Heavy Chain FN3 domains | Light Chain FN3 domains |
|---|---|---|---|---|---|---|
| 24 | 918 HC 67 LC | CR5133 PRASA A6 HC-L4-E-L4-AB FLAG | anti-glycosylated SDR-containing proteins | E223P/ L234V/ L235A (G236-deleted) S239D/ K326A/ E333A/ H435R/ Y436F | anti-LukE anti-LukAB | none |
| 25 | 919 HC 67 LC | cMyc CR5133 PRASA A6 HC-L4-E-L4-AB | anti-glycosylated SDR-containing proteins | E223P/ L234V/ L235A (G236-deleted) S239D/ K326A/ E333A/ H435R/ Y436F | anti-LukE anti-LukAB | none |
| 26 | 920 HC 67 LC | cMyc CR5133 PRASA A6 HC-L4-E-L4-AB FLAG | anti-glycosylated SDR-containing proteins | E223P/ L234V/ L235A (G236-deleted) S239D/ K326A/ E333A/ H435R/ Y436F | anti-LukE anti-LukAB | none |
| 27 | 977 HC 843 LC | RSV PRASA A6 HC-L4-wtTENCON | anti-RSV (CNTO3930) | E223P/ L234V/ L235A (G236-deleted) S239D/ K326A/ E333A/ H435R/ Y436F | wt-TENCON | none |
| 28 | 858 HC 67 LC | CR5133 PRASA A6 HC-L4-E-L4-AB | anti-glycosylated SDR-containing proteins | E223P/ L234V/ L235A (G236-deleted) S239D/ K326A/ E333A/ H435R/ Y436F | anti-LukE anti-LukAB | none |
| 29 | 1000 HC 841 LC | ProA3 PRASA A6 | Anti-Protein A | E223P/ L234V/ L235A (G236-deleted) S239D/ K326A/ E333A/ H435R/ Y436F | None | None |
| 30 | 1001 HC 841 LC | ProA3 IgG1 | Anti-Protein A | IgG1 WT | None | None |
| 31 | 1002 HC 841 LC | ProA3 PRASA | Anti-Protein A | E223P/ L234V/ L235A (G236-deleted) S239D/ K326A/ E333A/ | None | None |
| 32 | 1003 HC 846 LC | LTA IgG1 | Anti-LTA (Pagibaximab) | IgG1 WT | None | None |
| 33 | 1004 HC 846 LC | LTA PRASA A6 | Anti-LTA (Pagibaximab) | E223P/ L234V/ L235A (G236-deleted) S239D/ K326A/ E333A/ H435R/ Y436F | None | None |

TABLE 1-continued

Characteristics of Antibody and Antibody-FN3 Fusion Constructs

| Construct No. | SEQ ID NO: | Description | V-region | Heavy Chain | Heavy Chain FN3 domains | Light Chain FN3 domains |
|---|---|---|---|---|---|---|
| 34 | 1078 HC 1079 LC | anti-LukAB mIgG1 | anti-LukAB | mIgG1 WT | None | None |
| 35 | 1080 HC 1081 LC | anti-LukAB Fab | anti-LukAB | hIgG1 Fab | None | None |
| 36 | 1082 HC 1083 LC | anti-gSDR Fab | anti-gSDR | hIgG1 Fab | None | None |
| 37 | 848 HC 979 LC | CR5133 PRASA A6 LC-L4-AB HC-L4-E | anti-glycosylated SDR-containing proteins | E223P/ L234V/ L235A (G236-deleted) S239D/ K326A/ E333A/ H435R/ Y436F | anti-LukE | anti-LukAB |
| 38 | 70 HC 980 LC | CR5133 PRASA A6 LC-L4-E HC-L4-AB | anti-glycosylated SDR-containing proteins | E223P/ L234V/ L235A (G236-deleted) S239D/ K326A/ E333A/ H435R/ Y436F | anti-LukAB | anti-LukE |

Abbreviations:
PRASA - heavy chain mutations that eliminate GluV8-mediated protease cleavage in the hinge region;
A6 - Fc region mutations that that eliminate protein-A binding;
HC - heavy chain;
LC - light chain.

Example 2: Target Antigen Engagement by mAb 5133 and mAb 5133-FN3 Fusion Proteins; Simultaneous Target Engagement, Target Binding Stoichiometry and Binding Affinity The roles that individual SDR proteins and the leukotoxins LukAB and LukED play in establishing and/or maintaining *S. aureus* infections in different tissue sites is predicted to vary. In some settings, glycosylated forms of the SDR proteins may be important in serving as adhesins to host tissues or soluble factors in the systemic blood circulation or other fluids in either the host extracellular environment or sub-cellular bodies in the host intracellular environment via specific host surface receptors (Hazenbos et al., "Novel Staphylococcal Glycosyltransferases SdgA and SdgB Mediate Immunogenicity and Protection of Virulence-Associated Cell Wall Proteins," *PLoS Pathog.* 9(10): e1003653 (2013); Thomer et al., "N-Acetylglucosaminylation of Serine-Aspartate Repeat Proteins Promotes *Staphylococcus aureus* Bloodstream Infection," *J. Biol. Chem.* 289(6):3478-86 (2014), which are hereby incorporated by reference in their entirety). In contrast, the leukotoxins LukAB and LukED likely play distinct roles in mediating invasive disease through their targeted cytolytic activity against specific classes of immune cells (Yoong & Torres, "The Effects of *Staphylococcus aureus* Leukotoxins on the Host: Cell Lysis and Beyond," *Curr. Opin. Microbiol.* 16(1):63-9 (2013), which is hereby incorporated by reference in its entirety). Similarly, the roles of these different virulence factors in facilitating *S. aureus* survival in, or escape from, the intracellular environment of host cells (e.g., the phagolysosome) is not fully characterized although it has been established that LukAB facilitates the escape of bacteria engulfed within human polymorphonuclear leukocytes (PMNs) (Dumont et al., "*Staphylococcus aureus* Elaborates Leukocidin AB to Mediate Escape From Within Human Neutrophils," *Infect. Immun.* 81(5):1830-41 (2013), which is hereby incorporated by reference in its entirety. Considering the possibility that both SDR family proteins and the leukotoxins LukAB and LukED are important common virulence factors in some infection settings, it was important to demonstrate that mAb 5133-FN3 fusion proteins can engage multiple protein targets simultaneously. Herein, the interaction of mAb 5133-FN3 fusion proteins with purified target antigen proteins is described as determined using the Biacore surface plasmon resonance (SPR) methodology.

Procedure.

The leukotoxin binding FN3 domains of the mAb5133-FN3 fusion proteins used in this and in other Examples described herein were developed as described in PCT Application Publication No. WO2015089073 to Torres et al., which is hereby incorporated by reference in its entirety. Characteristics of the mAB5133-FN3 fusion constructs utilized herein are provided in Table 1. In these studies mAb 5133-based mAbs and mAb-5133-FN3 fusion proteins were captured as ligands on goat anti-human Fc antibody (Jackson ImmunoResearch product #109-005-098) modified CM4 sensor chips (Biacore Life Sciences product BR-1005-34) using the Biacore T200 instrument. Binding studies employed as target analytes (i) a single SdgB glycosylated preparation of the SdrC4 protein (SEQ ID NO: 100) as the V-region target antigen referred to herein as SdrC4GlcNac, (ii) a recombinant polyhistidine-tagged variant of LukE (SEQ ID NO: 13) prepared from *S. aureus*, and (iii) a recombinant polyhistidine-tagged, toxoid variant of LukAB (LukA variant of SEQ ID NO: 10 and LukB of SEQ ID NO: 11) prepared from *S. aureus* that bears an E323A mutation (DuMont et al., "Identification of a Crucial Residue Required for *Staphylococcus aureus* LukAB Cytotoxicity and Receptor Recognition," *Infect Immun.* 82(3): 1268-76 (2014), which is hereby incorporated by reference in its entirety). Binding studies employed 0. µM filtered, degassed PBS/Tween/EDTA, pH7.4 buffer (Bio-Rad Phosphate buffered saline, pH 7.4, 0.005% Tween 20 (GE Healthcare product BR100054), 3 mM EDTA) as both the ligand immobilization running buffer (IRB) and the Biacore running buffer (BRB). The kinetic binding data was obtained using the "single cycle kinetics" mode on the Biacore T200 instrument at an analyte flow rate of 60 µL/minute and dissociation monitored for 900 seconds. In summary, data analysis was performed by (i) subtracting the curves generated by buffer injection (average) from the reference-subtracted curves for analyte injections to correct for buffer contribution to the signal and instrument noise (Myszka, "Improving Biosensor Analysis," *J. Mol. Recognition.* 12:279-284 (1999), which is hereby incorporated by reference in its entirety) and (ii) the resulting processed data generated for kinetic and affinity determinations analyzed using the T200 BIAevaluation software with kinetic data analyzed using a simple 1:1 binding model for LukAB and LukE and a two-state model for SdrC4GlcNac (Jonsson & Malmqvist, "Real Time Biospecific Interaction Analysis: The Integration of Surface Plasmon Resonance Detection, General Biospecific Interface Chemistry and Microfluidics Into One Analytical System," *Advances in Biosensor,* 2:291-336 (1992); Morton & Myszka, "Kinetic Analysis of Macromolecular Interactions Using Surface Plasmon Resonance Biosensors," *Methods in Enzymol.* 295:268-294 (1998); Svitel et al., "Probing the Functional Heterogeneity of Surface Binding Sites by Analysis of Experimental Binding Traces and the Effect of Mass Transport Limitation," *Biophysical Journal,* 92:1742-1758 (2007); Drake et al., "Characterizing High-Affinity Antigen/Antibody Complexes by Kinetic- and Equilibrium-Based Methods," *Anal Biochem* 328(1):35-43 (2004), which are hereby incorporated by reference in their entirety).

Results.

Test article ligands captured on CM4 sensor chips via the goat anti-human Fc antibody were mAb 5133 PRASA A6 (Table 1: construct 4/SEQ ID NO: 66 HC plus SEQ ID NO:67 LC), mAb 5133 PRASA A6 HC-L4-AB (Table 1: construct 6/SEQ ID NO: 70 HC plus SEQ ID NO:71 LC), mAb 5133 PRASA A6 HC-L4-E (Table 1: construct 15/SEQ ID NO: 848 HC plus SEQ ID NO:71 LC) and mAb 5133 PRASA A6 HC-L4-E-L4-AB (Table 1: construct 11/SEQ ID NO:856 HC plus SEQ ID NO:67 LC). In an initial phase of target binding (Phase A), SdrC4GlcNac (glycosylated SdrC4 protein at 450 nM) was bound to the immobilized ligands until apparent saturation. As shown in the Phase A of binding in FIG. 2A, all CM4 sensor bound ligands bound the glycosylated SdrC4 protein as reflected in the increase in Response Units (RUs) from baseline. As shown in Phase B in FIG. 2A, addition of LukE (at 1 µM) to the flow solution resulted in further increases in RUs for test article ligands constructs 15 and 11 that bear LukE-targeted FN3 domains. Finally, as shown in the Phase C in FIG. 2A, addition of LukAB (at 100 nM) to the flow solution resulted in further increases in the observed RUs for test article construct 6 (mAb 5133 PRASA A6 HC-L4-AB) and construct 11 (mAb 5133 PRASA A6 HC-L4-E-L4-AB); again, this was expected as they each bear LukAB-targeted FN3 domains. In contrast, no apparent binding of LukAB by construct 4 (mAb 5133 PRASA A6) or construct 15 (mAb 5133 PRASA A6 HC-L4-E) was detected, consistent with the absence of LukAB-targeted FN3 domains in these proteins.

Analysis of these binding data allows for the quantitative assessment of the binding stoichiometry of each target antigen and these data are shown in FIG. 2B. In all cases wherein the test articles contained a FN3 domain specific for LukE, a binding stoichiometry of >1 (range of 1.2-1.5) was observed indicating that some portion of the total immobilized ligands engaged two copies of the LukE antigen simultaneously. Similarly, in all cases wherein the test articles contained a FN3 domain specific for LukAB, a binding stoichiometry of >1 (range of 1.4-1.8) was observed indicating that some portion of the total immobilized ligands engaged two copies of the LukAB antigen simultaneously.

Finally, analysis of these binding data also allows for the determination of the binding affinity of each target antigen and these data are shown in FIG. 2C. For test articles bearing the mAb5133-derived V-region, the affinity of binding to the glycosylated SdrC4 protein was observed to be fairly consistent with $K_D$ values in the 0.63-0.99 nM range. Similarly, for test articles containing a FN3 domain specific for LukE, the affinity of binding to LukE was observed to be fairly consistent with $K_D$ values in the 0.88-1.01 nM range. In contrast, for test articles containing a FN3 domain specific for LukAB, the binding affinity of Construct 11 (12 pM) was determined to be approximately six-fold higher than that observed for Construct 6 (70 pM). These data indicate that local sequence context can impact the affinity of FN3 domains for target antigens. Specifically, the affinity of the Luk17 FN3 domain appears to be enhanced when appended downstream of Luk26 in Construct 11 (mAb 5133 PRASA A6 HC-L4-E-L4-AB) when compared to its appendage to the carboxyl-terminus of mAb 5133 in Construct 6 (mAb 5133 PRASA A6 HC-L4-AB). Changes in the affinity of FN3 binding domains for their target antigens based on their local sequence context in mAb-FN3 fusion proteins are non-obvious and cannot be predicted a priori.

Summary.

These data provide evidence that mAb 5133-FN3 fusion proteins targeting LukAB and LukE can engage both toxin targets simultaneously while engaged via the V-region of the antibody portion with the SD-GlcNac antigen. This feature of mAb 5133-FN3 fusion proteins may be of significance in host tissues and/or organelles in some disease states mediated by *S. aureus* wherein roles for the glycosylated forms of the SDR family of adhesin proteins plus leukotoxins AB and/or ED are important in establishing and/or maintaining infection. Similarly, the apparent ability of mAb 5133-FN3 fusion proteins to bind both LukAB and LukE simultaneously may also be important in *S. aureus* disease states where both leukotoxins are expressed. The apparent binding stoichiometry of >1 for each toxin target antigen would presumably enable higher neutralization than afforded if the binding of a single LukAB molecule precluded binding of a second LukAB molecule or the binding of a single LukE molecule precluded binding of a second LukE molecule. Finally, the observation that the context of a FN3 domain in mAb-FN3 fusion proteins can have a significant impact on target affinity suggests that target engagement of mAb-FN3 fusion proteins may be optimized through modulating sequence context through exploring appendage at different positions to the light and/or heavy chains of the mAb and through exploring FN3 domain order in mAb-FN3 fusion proteins bearing tandem FN3 domains. Each of these findings was unexpected and could not be predicted a priori.

Example 3: Target Engagement by mAb 5133-FN3 Fusion Proteins: The Affinity of the FN3 Components for Leukotoxin Targets and In Vivo Efficacy can be Modulated by Alteration of Linker Lengths The length and nature of the linker sequences used in multi-specific fusion proteins can affect the activity and/or in vivo efficacy of the individual components, presumably by altering target (antigen) interactions and/or factors that influence in vivo pharmacokinetics-pharmacodynamics (PK-PD). Described herein is the synthesis and characterization of a series of 24 derivatives of a single mAb 5133-FN3 fusion protein (Construct 11 in Table 1; SEQ ID NO: 856 HC plus SEQ ID NO:67 LC), where the linker length between the carboxyl-terminus of the mAb heavy chain and the first FN3 domain (targeting LukE) is varied from zero to four copies of the $G_4S$ linker (hereinafter referred to as 'Linker 1'), and similarly, the linker length between the carboxyl-terminus of the first FN3 domain (targeting LukE) and the amino-terminus of the second FN3 domain (targeting LukAB) is varied from zero to four copies of the $G_4S$ linker (hereinafter referred to as 'Linker 2').

Procedure.

Derivatives of the mAb 5133-FN3 fusion protein Construct 11 (CR5133 PRASA A6 HC-L4-E-L4-AB; SEQ ID NO:856 HC plus SEQ ID NO:67 LC) with variable linker lengths were synthesized by standard molecular methods and purified proteins prepared from transiently transfected Human Embryonic Kidney (HEK) 293 cells. The binding affinity of each leukotoxin target, i.e., LukE (SEQ ID NO: 13), and a LukAB toxoid variant (SEQ ID NOs: 10 and 11) that bears a mutation corresponding to E323A in the wild-type toxin (DuMont et al., "Identification of a Crucial Residue Required for *Staphylococcus aureus* LukAB Cytotoxicity and Receptor Recognition," *Infect Immun.* 82(3): 1268-76 (2014), which is hereby incorporated by reference in its entirety), was determined by ELISA. Briefly, 100 µl of a 5 µg/mL solution of streptavidin (in PBS) was added per well of a 96 well White Maxisorp plate (Nunc-cat#436110) and incubated overnight at 4° C. Wells were washed 3× with TBST (50 mM Tris HCl, pH 7.4, 150 mM NaCl, 0.1% Tween 20) and blocked with 300 µL/well with StartingBlock T20 (Pierce cat#37543) and incubated 45-60 minutes at room temperature (RT). The plate was washed 3 times with TBST and 0.2 µg of biotinylated versions of the leukotoxin target antigens (in 100 µL) added to each test well and the plate incubated 45-60 minutes at RT with gentle shaking. The plate was washed 3 times with TBST. In separate dilution plates, test articles were serially diluted three-fold in blocking buffer starting at 10 µM. ELISA plates were washed three times with ELISA wash buffer and antibody dilutions were transferred from the dilution plates to the ELISA plates and incubated for one hour at ambient temperature with gentle shaking. ELISA plates were washed three times with ELISA wash buffer and a secondary goat anti-human Fc gamma-specific-HRP (Jackson Immunoresearch 109-035-098) was diluted 1:10,000 in blocking buffer and added to the plates. Plates were incubated with secondary antibody for one hour at ambient temperature then washed four times with ELISA wash buffer. POD Chemiluminescence substrate (Roche-cat#11582950001) was then added to the plates and absorbance was read immediately on the Perkin Elmer EnVision Multilabel Reader at 405 nm. The data were analyzed using GraphPad Prism. Values were transformed to a log scale and fit using a non-linear regression sigmoidal dose-response equation resulting in an eleven point binding curve for each antibody against each antigen.

A mouse model of *S. aureus* kidney infections was used to assess the relative in vivo efficacy of the mAb-FN3 fusion linker variants. Briefly, female 5-6 week old Swiss Webster ND4 mice (Harlan Laboratories, Indianapolis, Ind.) were administered test articles (8 per group) via intra-peritoneal (IP injection) 24 hours prior to infection. Mice were subsequently infected with a pre-determined fixed concentration (~10^6 Log 10 CFU per mouse) of *S. aureus* Newman injected in a 100 µL volume retro-orbitally (under isoflurane anesthesia) using a 28 G, ½ inch needle. This concentration corresponded to the lowest bacterial inoculum that typically yields a robust kidney infection as defined by the resulting bacterial burden based on determinations of colony forming units (CFUs) measured from homogenates of explanted kidneys and the visual observation and enumeration of kidney surface abscess lesions. In all cases, test articles were administered 24 hours prior to infection. Mice were euthanized, and kidneys harvested 96 hour post infection. Kidneys were scored for severity of infection via visual lesion count. The kidneys were explanted, weighed, homogenized, and the resulting homogenates serially diluted and plated on bacterial growth media (Tryptic Soy Agar (TSA)) to determine terminal viable bacterial burdens per individual kidneys via the CFU endpoint. Mice were monitored daily for health observations. The kidney severity abscess score was recorded as: 1-2 visible lesions=severity score 1, 3-9 visible lesions=severity score 2, and >=10 visible lesions=severity score 3.

Results.

Figure 3A:
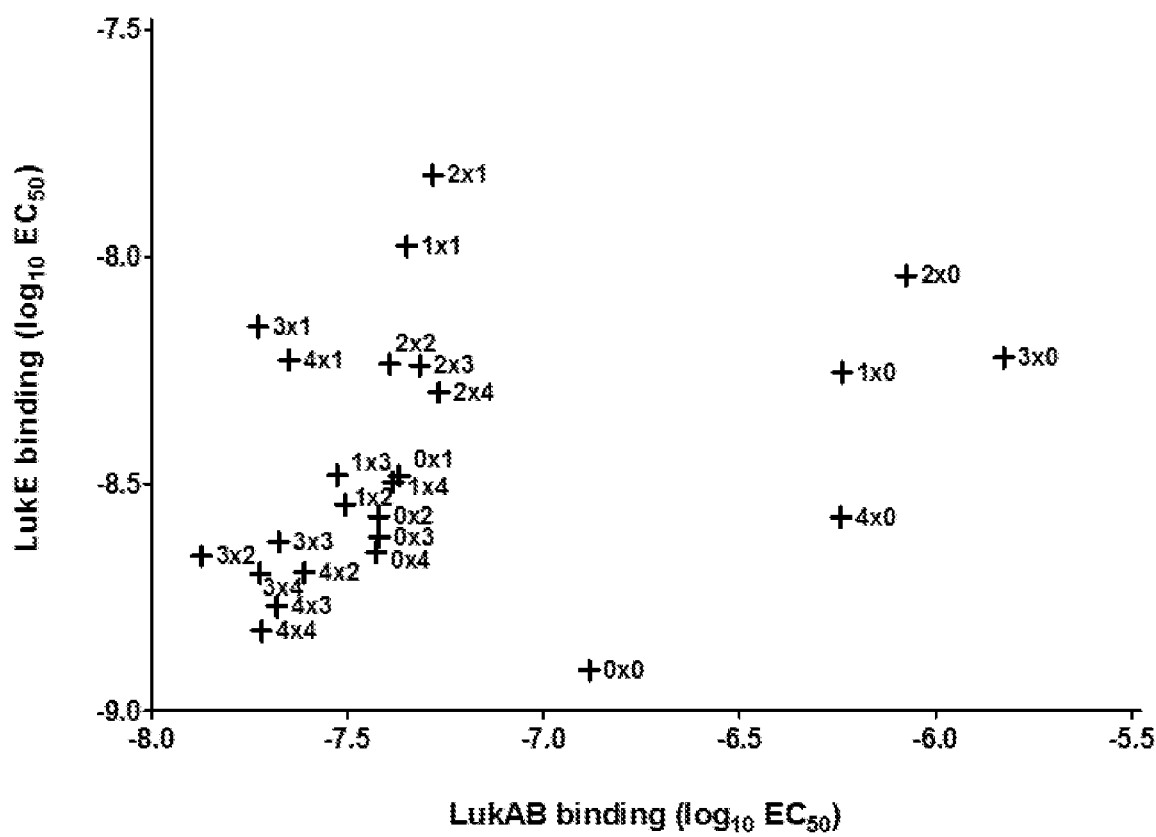

The influence of varying linker lengths on leukotoxin binding affinity could not be predicted a priori and the data in FIG. 3A exemplifies the nonobvious impact that such variations of Linker 1 and Linker 2 have on the binding affinity for both toxin antigens. For instance, with regard to Linker position 1, variants with no copies of the $G_4S$ linker (0×0, 0×1, 0×2, 0×3 and 0×4) between the carboxyl-terminus of the mAb heavy chain and the first FN3 domain (targeting LukE) exhibit near equivalent binding affinities for LukE and LukAB as the 4×4 variant with the exception that the 0×0 variant exhibits somewhat weaker binding to LukAB. In contrast, with regard to Linker position 2, variants with no copies of the $G_4S$ linker (0×0, 1×0, 2×0, 3×0 and 4×0) between the carboxyl-terminus of the first FN3 domain (targeting LukE) and the amino-terminus of the second FN3 domain (targeting LukAB) all exhibit significantly reduced binding to LukAB when compared to the 4×4 variant, and variable reductions in affinity for binding to LukE compared to the 4×4 variant with the exception of the 0×0 variant. Overall, the lack of discernible trends between toxin binding affinities and the lengths of Linker 1 and Linker 2 highlights the impact that each linker can have on the binding to each of the toxin targets, and therefore, the need to neutrally assess a broad panel of linker variants in optimizing these mAb-FN3 fusion proteins with regard to their binding affinities for the toxin targets.

Figure 3C:
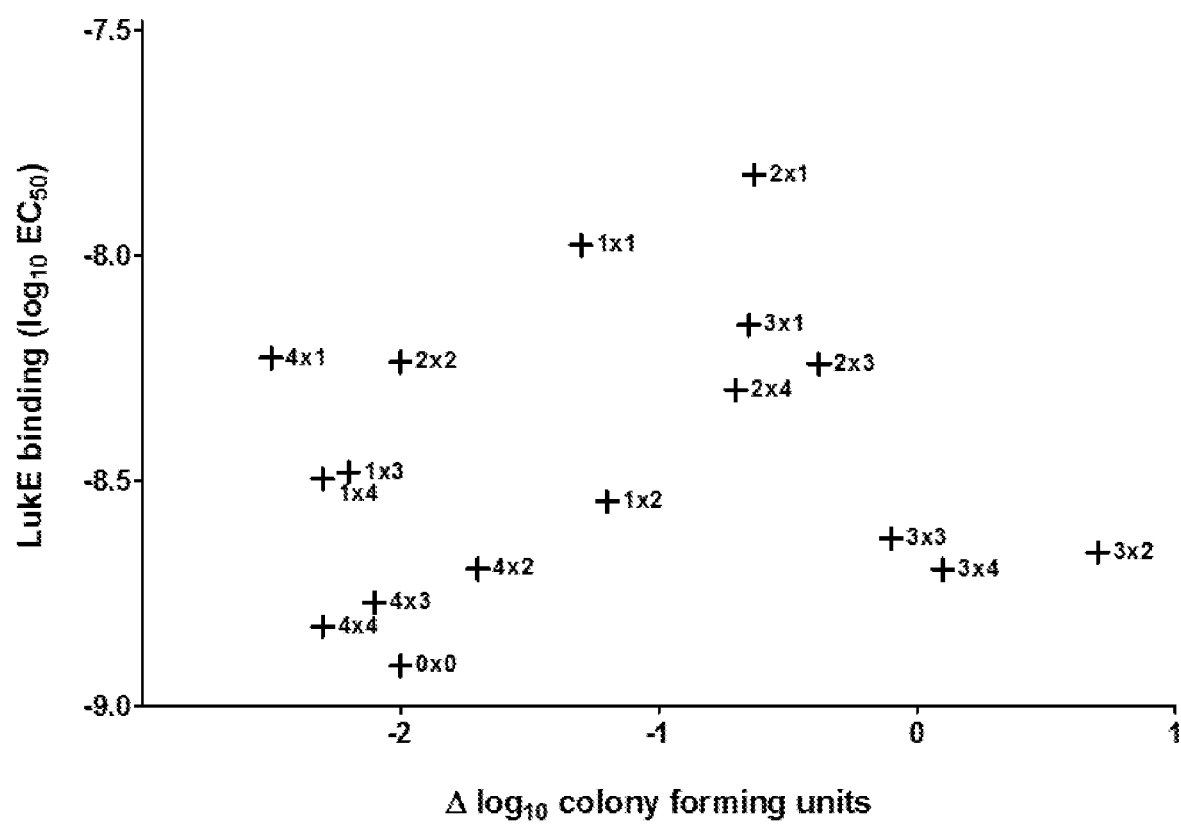
Figure 3D:
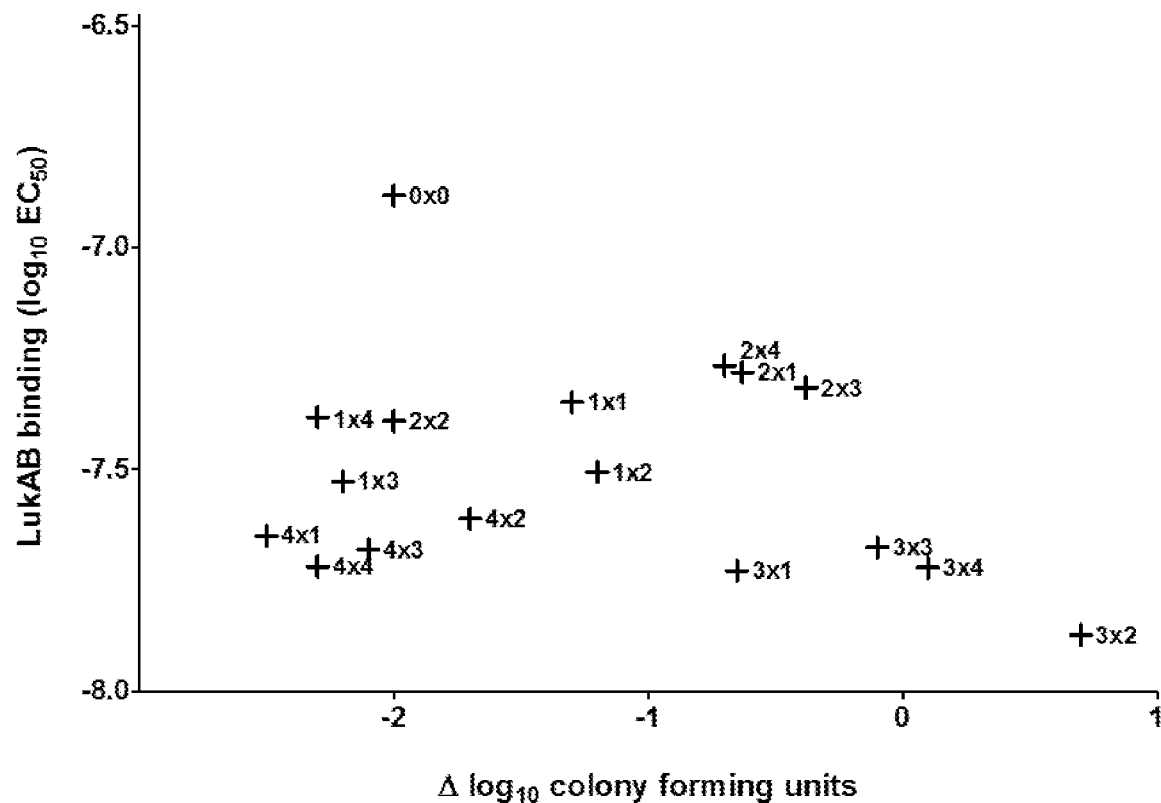

Similarly, the influence of varying linker lengths on in vivo efficacy could not be predicted a priori and the data in FIGS. 3B, 3C, and 3D exemplifies the nonobvious impact that such variations of Linker 1 and/or Linker 2 have on the efficacy in a mouse model of *S. aureus* kidney infections. For instance, the 1×4 and 4×4 variants exhibit equivalent (high) efficacy and retain potent binding to both LukE and LukAB (FIGS. 3C and 3D, respectively). In contrast, while the 3×2, 3×3 and 3×4 variants exhibit potent binding to both LukE and LukAB, they exhibit weak or no in vivo efficacy (FIGS.

3C and 3D, respectively). Hence, the relationship between linker length and efficacy cannot simply be explained by changes in toxin binding affinity as differences in linker composition will likely impact factors that influence in vivo pharmacokinetics-pharmacodynamics (PK-PD). Again, these data highlight the need to neutrally assess a broad panel of linker variants in optimizing these mAb-FN3 fusion proteins with regard to in vivo efficacy.

Summary.

The influence of varying linker lengths of mAb 5133-FN3 fusion proteins on in vitro and in vivo activities could not be predicted a priori. As exemplified herein through studies of leukotoxin target binding, toxin neutralization and in vivo efficacy of a broad panel of linker variants of a single mAb 5133-FN3 fusion protein, the nonobvious impact that such variations of Linker 1 and/or Linker 2 have on in vitro, ex vivo and in vivo activity was borne out. These studies highlight the potential for optimizing the activity of mAb 5133-FN3 fusion proteins through varying the $G_4S$ linker length employed between the carboxyl-terminus of the mAb heavy chain and the first FN3 domain and, where relevant, the linker length between the carboxyl-terminus of the first FN3 domain and the amino-terminus of the second FN3 domain.

Example 4: Correlation of Toxin Binding and Neutralizing Activity of FN3 Variants Targeting the LukE Component of Leukotoxin LukED The specificity in leukotoxin binding and neutralization observed for some FN3 variants implies that they interact in a highly specific manner. In an effort to define key molecular interactions between the FN3 protein and the LukE subunit, mutant derivatives of a series of three LukE-specific FN3 variants, specifically Luk26 (SEQ ID NO: 25), Luk27 (SEQ ID NO: 26) and Luk38 (SEQ ID NO: 37) were prepared in which residues that differ from the parental, wild-type TENCON FN3 protein (SEQ ID NO: 1) were each individually changed to Alanine to create a so-called 'Alanine Scan' set of variants across the putative LukE binding surface. Each variant was then assessed for (i) retention of binding to purified, recombinant LukE protein as determined in an ELISA format assay, and (ii) for LukED toxin neutralization activity in assays employing isolated primary human neutrophils.

Procedure.

Binding of the FN3 variants to purified, recombinant LukE protein (SEQ ID NO: 13) was determined by ELISA. Briefly, 100 µl of a 5 µg/mL solution of streptavidin (in PBS) was added per well of a 96 well White Maxisorp plate (Nunc-cat#436110) and incubated overnight at 4° C. Wells were then washed 3× with TBST (50 mM Tris HCl, pH 7.4, 150 mM NaCl, 0.1% Tween 20) and blocked with 300 µL/well with StartingBlock T20 (Pierce cat#37543) and incubated 45-60 minutes at room temperature (RT). The plate was then washed 3 times with TBST and 0.2 µg of a biotinylated preparation of LukE protein (in 100 µL) was added to each test well and the plate incubated 45-60 minutes at RT with gentle shaking. The plate was then washed 3 times with TBST. In separate dilution plates, test articles were serially diluted three-fold in blocking buffer starting at 1 µM. 100 µL of titrated test articles were added to test wells and the plate incubated 45-60 minutes at RT with gentle shaking. The plate was then washed 3 times with TBST. For detection of bound test articles, 100 µL/well of a polyclonal anti-FN3-HRP antibody diluted 1:5000 in Starting block T20 was added and the plate incubated for 45-60 min at RT with gentle shaking. The plate was then washed 3 times with TBST. To detect bound anti-FN3-HRP antibody, 100 µL/well of the POD Chemiluminescence substrate (Roche-cat#11582950001) was added immediately prior to reading plates and the plates read using a Paradigm or Envision reader within 15 minutes of the substrate addition. The data were analyzed using GraphPad Prism. Values were transformed to a log scale and fit using a non-linear regression sigmoidal dose-response equation resulting in an eleven point binding curve for each antibody against each antigen.

For LukED neutralization studies, the FN3 domain test articles (10 µg/mL in 100 µL reactions were incubated with purified, recombinant LukED (SEQ ID NOs: 12 & 13) for 30 mins at 4° C. Freshly isolated human primary polymorphonuclear leukocytes (hPMNs, 200,000 cells in RPMI+10 mM HEPES+0.1% HSA) were added to the mixture of toxin and FN3 domain protein to a final volume of 100 µl. Ethidium bromide was then added to the cells at 1:2000 final dilution and plates were read 30 and 60 mins post toxin addition. Following 1 hour intoxication in a 37° C. $CO_2$ incubator, 25 µl of supernatant was carefully transferred to a new plate after spinning the plate down at 1500 RPM for 10 mins. Cell Titer reagent (Promega) was added to the remaining cells and incubated for 1.5 hours. The 25 µl of supernatant were mixed with equal amounts of CytoTox-ONE™ Assay reagent (Promega) that rapidly measures the release of lactate dehydrogenase (LDH) from cells with a damaged membrane. LDH released into the culture medium was measured with a 10-minute coupled enzymatic assay that results in the conversion of resazurin into a fluorescent resorufin product. For the neutralization experiments, LukED was used at a concentration of 72.5 nM (2.5 µg/mL per subunit).

Results.

Figure 4A:
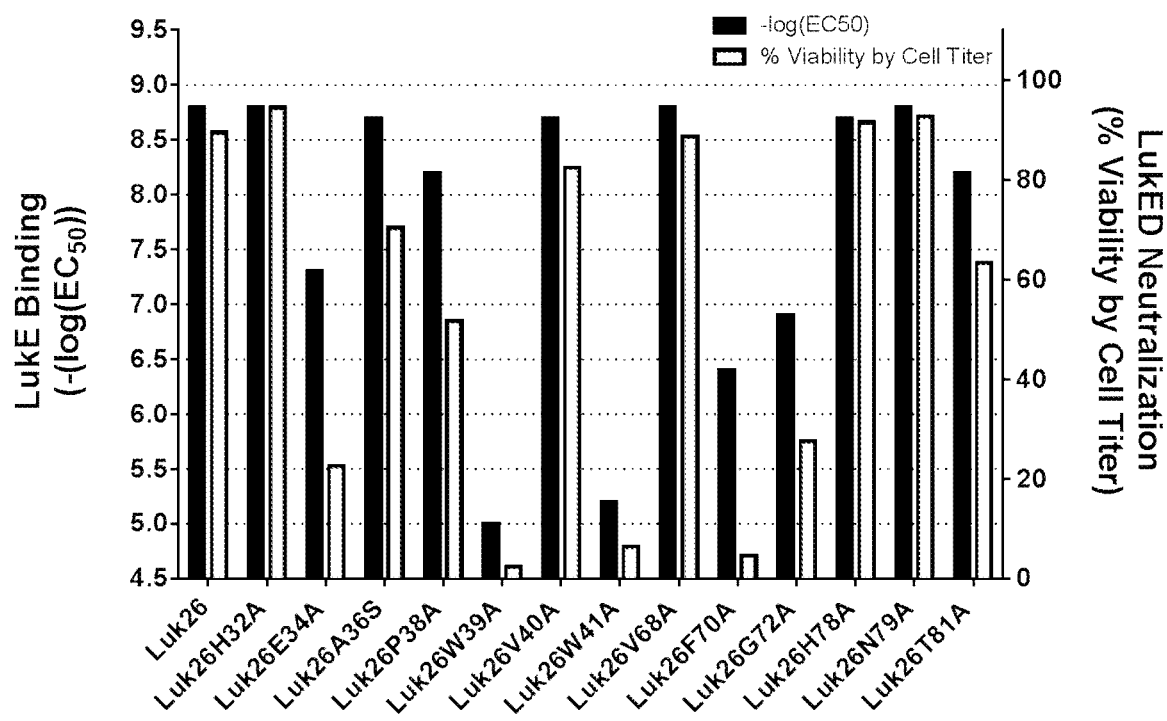
FIGS. 4A-4C show the correlation of toxin binding and neutralizing activity of a representative set of variants of three FN3 binding molecules containing LukE binding regions, i.e., Luk26 (FIG. 4A), Luk27 (FIG. 4B), and Luk38 (FIG. 4C).

As shown in FIG. 4A, there appears to be a reasonable correlation between LukE binding affinity and LukED toxin neutralization activity (as represented via the Cell Titer endpoint) in the 'Alanine scan' set of derivatives of the Luk26 FN3 protein. In no instance was LukE binding retained and neutralization lost. In contrast, two variants (W39A and W41A) exhibited a near total loss of LukE binding and LukED neutralization while other variants (e.g., E34A, F70A and G72A) exhibited reduced binding affinity and partial loss of LukED neutralization activity. These data identify key residues that appear to mediate highly specific LukE binding by Luk26 and therein define components of the FN3 paratope.

Figure 4B:
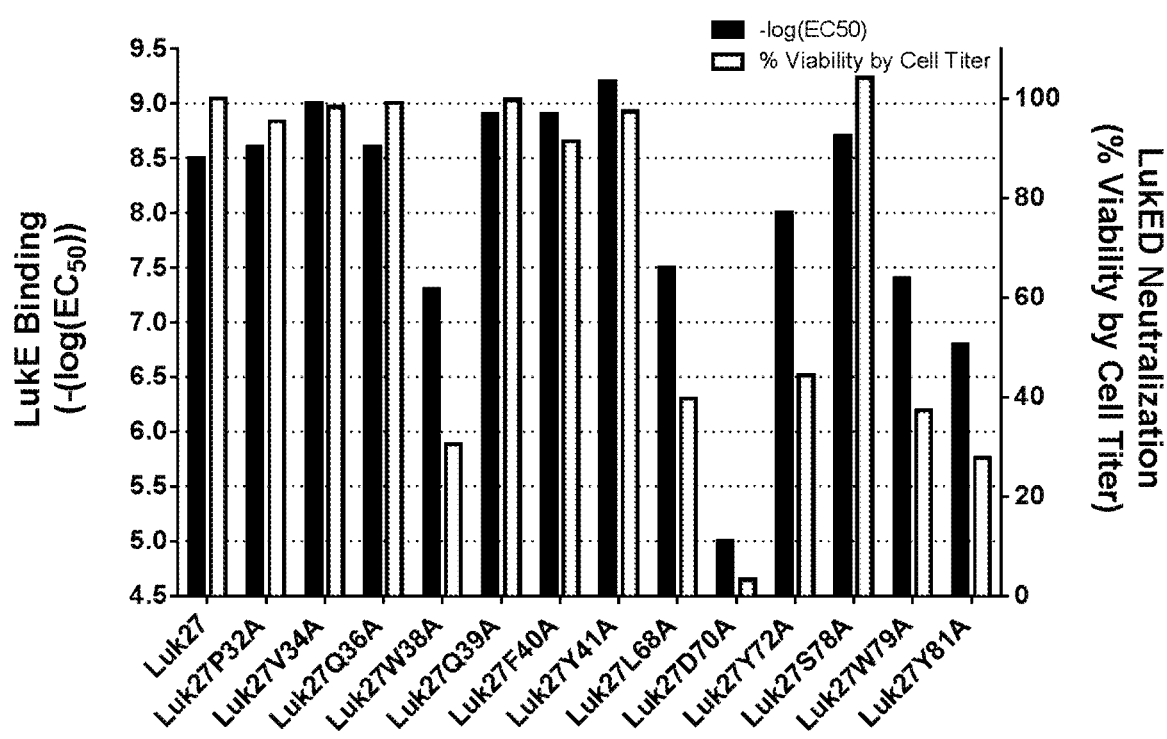

Similarly, as shown in FIG. 4B, there appears to be a reasonable correlation between LukE binding affinity and LukED toxin neutralization activity (as represented via the Cell Titer endpoint) in the 'Alanine scan' set of derivatives of the Luk27 FN3 protein. Again, in no instance was LukE binding retained and neutralization lost. In contrast, one variant (D70A) exhibited a near total loss of LukE binding and LukED neutralization while other variants (e.g., W38A, L68A, Y72A, W79A and Y81A) exhibited reduced binding affinity and partial loss of LukED neutralization activity. These data identify key residues that appear to mediate highly specific LukE binding by Luk27 and therein define components of the FN3 paratope.

Figure 4C:
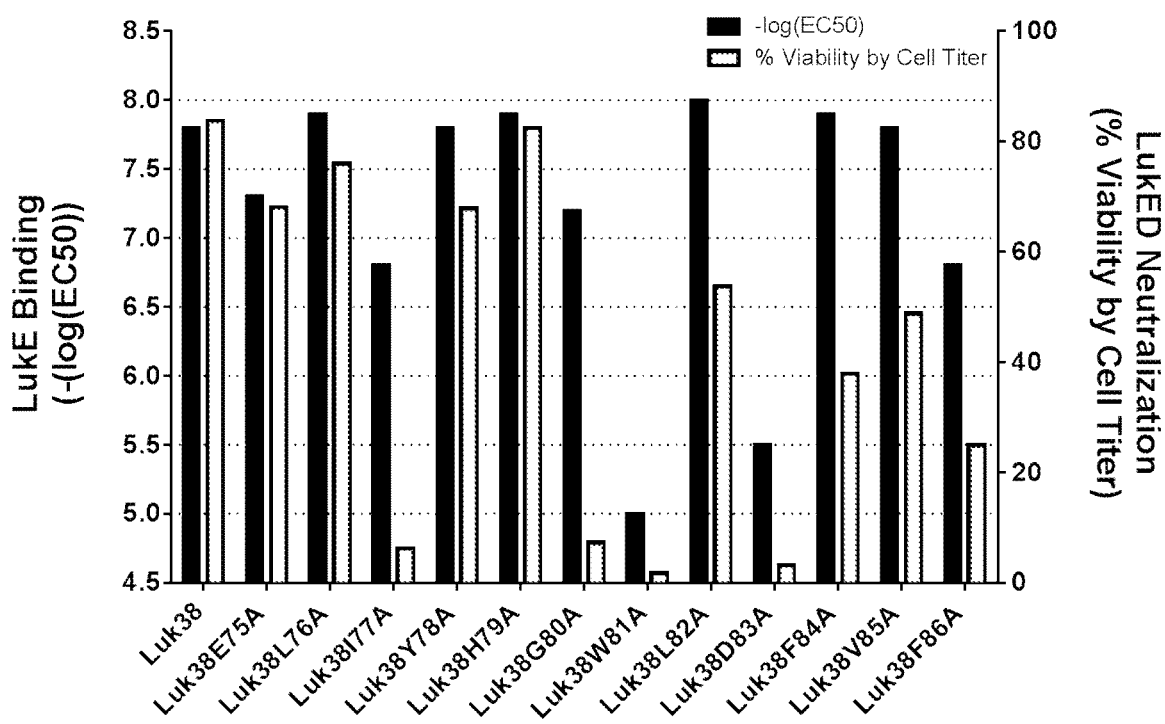

Finally, as shown in FIG. 4C, there appears to be a reasonable correlation between LukE binding affinity and LukED toxin neutralization activity (as represented via the Cell Titer endpoint) in the 'Alanine scan' set of derivatives of the Luk38 FN3 protein. Two variants (W81A and D83A) exhibited a near total loss of LukE binding and LukED neutralization while another variant (F86A) exhibited reduced binding affinity and partial loss of LukED neutralization activity. In other variants (e.g., I77A, G80A, F84A, V85A and F86A), LukE binding appeared to be significantly retained while LukED neutralization activity was significantly reduced. These data identify key residues that appear to mediate highly specific LukE binding by Luk38 and therein define components of the FN3 paratope.

Summary.

These data show that the Luk26, Luk27 and Luk38 FN3 domain proteins bind and neutralize LukED through a series of specific molecular interactions at their respective paratope-epitope surfaces. Further, the identification of residues in these LukE-specific FN3 proteins that when mutated to Alanine have no apparent impact on either LukE binding or LukED neutralization provides opportunities to further enhance the potency of LukE binding and LukED neutralization by changing these residues to alternate amino acids.

Example 5: Correlation of Toxin Binding and Neutralizing Activity of an FN3 Variant Targeting Leukotoxin LukAB The specificity in leukotoxin binding and neutralization observed for some FN3 variants implies that they interact in a highly specific manner. In an effort to define key molecular interactions between the FN3 protein and the LukAB toxin, mutant derivatives of Luk17 (SEQ ID NO: 14) were prepared in which residues that differ from the parental, wild-type TENCON FN3 protein (SEQ ID NO: 1) were each individually changed to Alanine to create a so-called 'Alanine Scan' set of variants across the putative LukAB binding surface. Each variant was then assessed for (i) retention of binding to purified, recombinant LukAB protein as determined in an ELISA format assay, and (ii) for LukAB toxin neutralization activity in assays employing isolated primary human neutrophils.

Procedure.

Binding of the FN3 variants to a purified, recombinant polyhistidine-tagged, toxoid variant of LukAB (SEQ ID NOs: 10 and 11) prepared from *S. aureus* that bears a mutation corresponding to E323A in the wild-type toxin sequence (DuMont et al., "Identification of a Crucial Residue Required for *Staphylococcus aureus* LukAB Cytotoxicity and Receptor Recognition," *Infect. Immun.* 82(3): 1268-76 (2014), which is hereby incorporated by reference in its entirety) was determined by ELISA. Briefly, 100 µl of a 5 µg/mL solution of streptavidin (in PBS) was added per well of a 96 well White Maxisorp plate (Nunc-cat#436110) and incubated overnight at 4° C. Wells were then washed 3× with TBST (50 mM Tris HCl, pH 7.4, 150 mM NaCl, 0.1% Tween 20) and blocked with 300 µL/well with StartingBlock T20 (Pierce cat#37543) and incubated 45-60 minutes at room temperature (RT). The plate was then washed 3 times with TBST and 0.2 µg of a biotinylated preparation of LukAB (E323A) protein (in 100 µL) was added to each test well and the plate incubated 45-60 minutes at RT with gentle shaking. The plate was then washed 3 times with TBST. In separate dilution plates, test articles were serially diluted three-fold in blocking buffer starting at 10 µM. 100 µL of titrated test articles were added to test wells and the plate incubated 45-60 minutes at RT with gentle shaking. The plate was then washed 3 times with TBST. For detection of bound test articles, 100 µL/well of a polyclonal anti-FN3-HRP antibody diluted 1:5000 in Starting block T20 was added and the plate incubated for 45-60 min at RT with gentle shaking. The plate was then washed 3 times with TBST. To detect bound anti-FN3-HRP antibody, 100 µL/well of the POD Chemiluminescence substrate (Roche-cat#11582950001) was added immediately prior to reading plates and the plates read using a Paradigm or Envision reader within 15 minutes of the substrate addition. The data were analyzed using GraphPad Prism. Values were transformed to a log scale and fit using a non-linear regression sigmoidal dose-response equation resulting in an eleven point binding curve for each antibody against each antigen.

For LukAB toxin neutralization studies, the FN3 domain test articles (40 µg per mL in a 100 µL reaction volume were incubated with purified, recombinant LukAB (SEQ ID NOs: 671 & 11) for 30 mins at 4° C. Freshly isolated human polymorphonuclear neutrophils (hPMNs, 200,000 cells in RPMI+10 mM HEPES+0.1% HSA) were added to the mixture of toxin and FN3 domain protein to a final volume of 100 µl. Ethidium bromide was then added to the cells at 1:2000 final dilution and plates were read 30 and 60 mins post toxin addition. Following 1 hour intoxication in a 37° C. $CO_2$ incubator, 25 µl of supernatant was carefully transferred to a new plate after spinning the plate down 1500 RPM for 10 mins. Cell Titer reagent (Promega) was added to the remaining cells and incubated for 1.5 hours. The 25 µl of supernatant were mixed with equal amounts of CytoTox-ONE™ Assay reagent (Promega) that rapidly measures the release of lactate dehydrogenase (LDH) from cells with a damaged membrane. LDH released into the culture medium was measured with a 10-minute coupled enzymatic assay that results in the conversion of resazurin into a fluorescent resorufin product. For the neutralization experiments, LukAB was used at a final concentration of 33.75 nM (1.25 µg/mL of each subunit).

Results.

Figure 5:
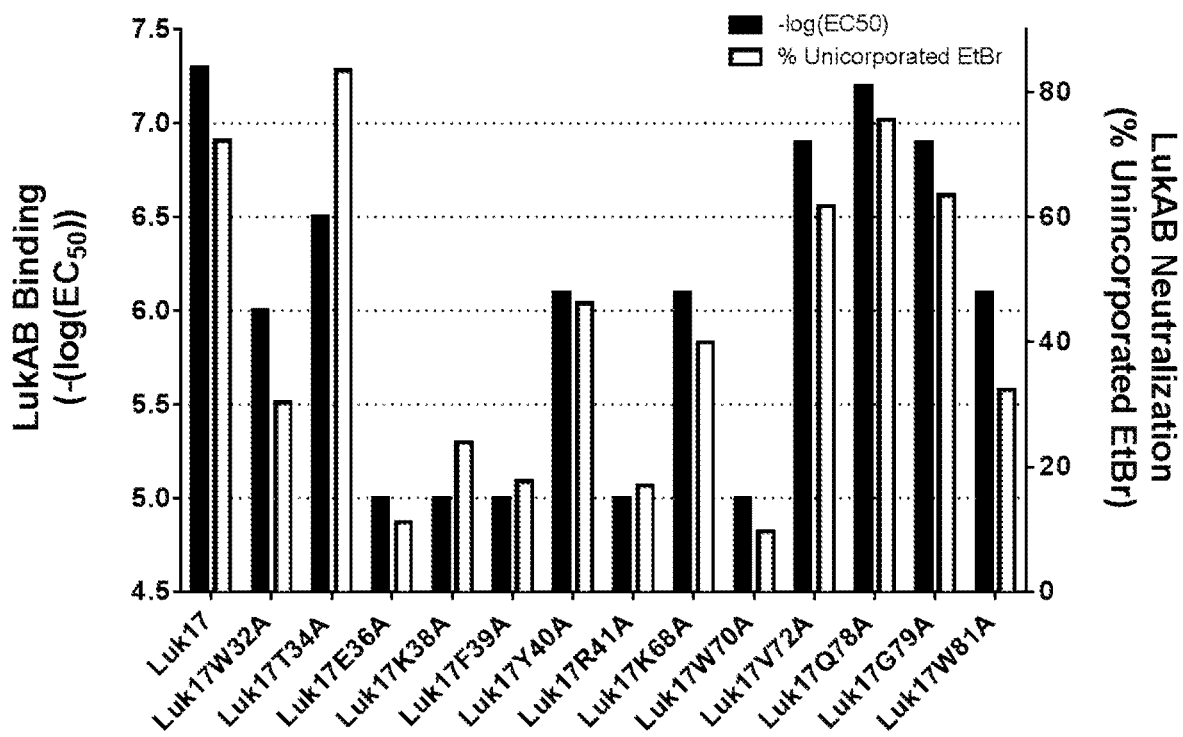
FIG. 5 shows the correlation of toxin binding and neutralizing activity of a representative set of FN3 variants targeting leukotoxin LukAB.

As shown in FIG. 5, there appears to be a good correlation between LukAB binding affinity and LukAB toxin neutralization activity (as represented by the ethidium bromide uptake endpoint) in the 'Alanine scan' set of derivatives of the Luk17 FN3 protein. In no instance was significant LukAB binding retained and toxin neutralization lost. In contrast, a series of variants (E36A, K38A, F39A, R41A and W70A) exhibited a near total loss of LukAB binding and LukAB neutralization while other variants (W32A, Y40A, K68A and W81A) exhibited reduced binding affinity and partial loss of LukED neutralization activity. These data identify key residues that appear to mediate highly specific LukAB binding by Luk17 and therein define components of the FN3 paratope.

Summary.

These data show that the Luk17 FN3 domain protein binds and neutralizes LukAB through a series of specific molecular interactions at the paratope-epitope surface. Further, the identification of residues in Luk17 that when mutated to Alanine have no apparent impact on either LukAB binding or neutralization provides opportunities to further enhance the potency of LukAB binding and neutralization by changing these residues to alternate amino acids.

Example 6: mAb 5133-FN3 Fusion Proteins have Improved Efficacy Compared to mAb-5133 in a Mouse Kidney Infection Model In understanding the relative contributions of the variable (V) region and/or the anti-toxin FN3 components of mAb 5133-based FN3 fusion proteins with regard to efficacy in animal models of human *S. aureus* infections, a series of test articles were compared with regard to their relative efficacy in a mouse renal (kidney) infection model of disease. Specifically, a series of test articles were evaluated "headto-head" that bear the same mAb 5133-derived V-region (targeting glycosylated forms of the SDR family of adhesins) but differ in their FN3 domain composition with regard to targeting of LukE alone or LukE and LukAB in combination. As an isotype IgG1 control, non-antistaphylococcal antibody, CNTO3930 (Construct 21 in Table 1; SEQ ID NO:104 HC plus SEQ ID NO:105 LC) was employed that targets the respiratory syncytial virus F (RSV-F) protein.

Procedure.

Female 5-6 week old Swiss Webster ND4 mice (Harlan Laboratories, Indianapolis, Ind.) were administered test articles (8 per group) via intra-peritoneal (IP) injection in a fixed dose volume of 200 µL/mouse 24 hours prior to infection. Mice were subsequently infected with a predetermined fixed concentration (~6.7×10^6 $Log_{10}$ CFU per mouse) of S. aureus Newman (Baba et al., "Genome Sequence of Staphylococcus aureus Strain Newman and Comparative Analysis of Staphylococcal Genomes: Polymorphism and Evolution of Two Major Pathogenicity Islands," J Bacteriol. 190(1):300-310 (2008), which is hereby incorporated by reference in its entirety) injected in a 100 µL volume retro-orbitally (under isoflurane anesthesia) using a 28 G, ½ inch needle. This infectious dose corresponds to the lowest bacterial inoculum that typically yields a robust kidney infection as defined by the resulting bacterial burden. Bacterial burden is determined by colony forming units (CFUs) measured from homogenates of explanted kidneys and the visual observation and enumeration of kidney surface lesions. In all cases, test articles were administered 24 hours prior to infection and mice euthanized and kidneys harvested 96 hour post infection. Mice were monitored daily for health observations. Kidneys were scored for severity of infection via visual lesion (abscess) count with the aid of a dissecting microscope, and then explanted, weighed, homogenized, and the resulting homogenates serially diluted and plated on bacterial growth media (Tryptic Soy Agar (TSA)) to determine terminal viable bacterial burdens per individual kidneys via the CFU endpoint. Mice were monitored daily for health observations. Statistical analysis of both the lesion data and bacterial burden (CFU) data was performed by calculating p-values using the Dunn's Method. Test articles evaluated were CNTO3930 (Construct 21 in Table 1; SEQ ID NO:104 HC plus SEQ ID NO:105 LC), mAb 5133 PRASA A6 (Construct 4 in Table 1; SEQ ID NO:66 HC plus SEQ ID NO:67 LC), mAb 5133 PRASA A6 HC-L4-E (Construct 15 in Table 1; SEQ ID NO:848 HC plus SEQ ID NO:71 LC) and mAb 5133 PRASA A6 HC-L4-E-L4-AB (Construct 11 in Table 1; SEQ ID NO:856 HC plus SEQ ID NO:67 LC). All test articles were administered IP at a dose of 500 µg per animal 24 hours prior to infection.

Results.

Figure 6:
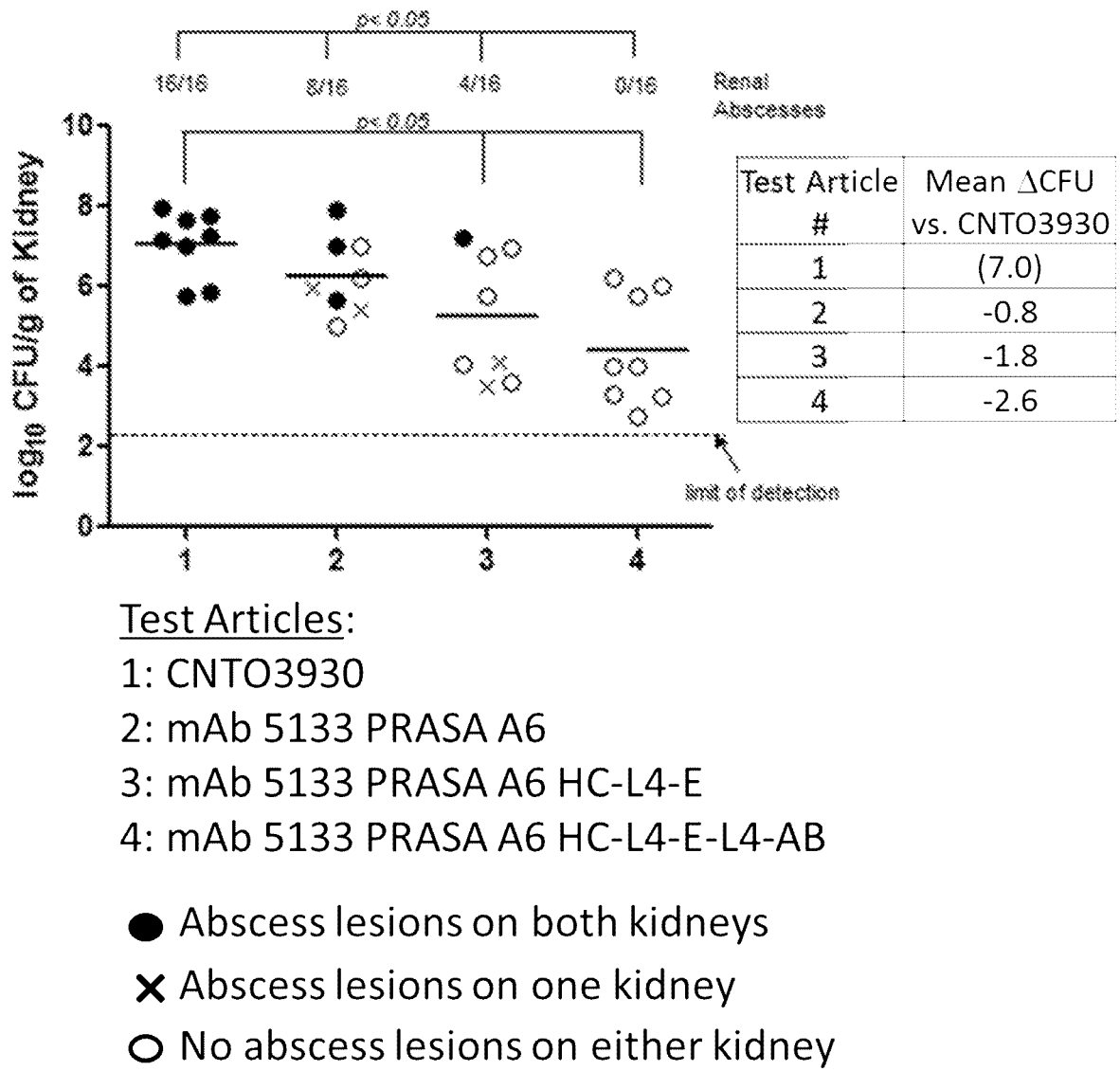
FIG. 6 shows that the potential therapeutic efficacy of mAb 5133-FN3 fusion proteins is improved over mAb-5133 in a mouse kidney infection model. Therapeutic efficacy was determined by measuring the number of colony forming units (CFU) and assessing the presence of kidney abscess lesions.

FIG. 6 shows the reductions in kidney severity scores, the total kidney surface lesions per group and the viable bacterial burdens per individual kidneys recovered for each dosed animal. As expected, treatment with the isotype control anti-RSV antibody (CNTO3930, Lane 1) resulted in the highest mean bacterial burden in the kidneys with a mean log 10 CFU/g kidney of 7.0 and with the highest visual evidence of lesions on each kidney harvested from the group of eight animals (16/16). Treatment with mAb 5133 PRASA A6 (Lane 2), reduced the bacterial burden in the kidney by minus 0.8 log 10 CFU/g compared to CNTO3930 and lowered kidney lesion incidence to 50% (8/16). Treatment with mAb 5133 PRASA A6 HC-L4-E (Lane 3) further reduced the bacterial burden in the kidney, specifically minus 1.8 $log_{10}$ CFU/g compared to CNTO3930 and lowered the kidney lesion incidence further to 25% (4/16). However, treatment with mAb 5133 PRASA A6 HC-L4-E-L4-AB (Lane 4) resulted in the highest overall efficacy as determined by either the bacterial burden in the kidney or lesion incidence. Specifically, treatment with mAb 5133 PRASA A6 HC-L4-E-L4-AB further reduced the bacterial burden in the kidney by minus 2.6 $log_{10}$ CFU/g compared to CNTO3930 and reduced kidney lesion incidence beyond the limit of detection (0/16).

Summary.

These data show that both the V-region and anti-toxin FN3 components of mAb5133-based FN3 fusion proteins are important contributors towards the overall efficacy observed in this mouse model of kidney infection. Treatment with mAb 5133 PRASA A6 resulted in efficacy improved over the non-antistaphylococcal mAb (CNTO3930) with a reduction in kidney lesion incidence of 50% and a reduced bacterial burden in the kidney of minus 0.8 $log_{10}$ CFU/g tissue. However, addition of a single FN3 fusion protein targeting LukE as exemplified in mAb 5133 PRASA A6 HC-L4-E resulted in a further reduction in kidney lesion incidence (25%) and a further reduction in bacterial burden in the kidney of minus 1.8 $log_{10}$ CFU/g tissue. However, addition of dual, tandem FN3 fusion proteins targeting LukE and LukAB as exemplified in mAb 5133 PRASA A6 HC-L4-E-L4-AB resulted in the highest overall reduction in bacterial burden in the kidney (minus 2.6 $log_{10}$ CFU/g tissue compared to CNTO3930) and a reduction in kidney lesion incidence beyond the limit of detection (0/16). In toto, these data suggest that both the V-region and anti-toxin FN3 components of mAb5133-based FN3 fusion proteins contribute towards efficacy in this mouse kidney infection model and further that mAb5133-based FN3 fusion proteins targeting both LukE and LukAB exhibit the best overall efficacy. Finally, these data suggest that the antigenic target of mAb 5133 (glycosylated forms of the SDR family of adhesins) and leukotoxins ED and AB are all contributory virulence factors in this mouse kidney infection model.

Example 7: mAb 5133 and mAb 5133-FN3 Fusion Proteins Exhibit Improved Efficacy in a Murine Renal Abscess Infection Model Compared to mAbs or mAb-FN3 Fusion Proteins Targeting Non-SDR S. aureus Protein Antigens In understanding the relative contributions of the V-region and/or the anti-leukotoxin FN3 components of mAb 5133-based FN3 fusion proteins with regard to efficacy in animal models of human S. aureus infections, a series of test articles were compared for their relative efficacy in a mouse renal (kidney) infection model of disease. Specifically, a series of test articles were evaluated "head-to-head" which differ only in their V-region component but are otherwise identical in their anti-toxin FN3 components as fused to the heavy chain of the mAb entity of the mAb-FN3 fusion protein. These included anti-staphylococcal antibodies targeting the iron regulated surface determinant B (IsdB) protein, (Ebert et al., "A Fully Human Monoclonal Antibody to Staphylococcus aureus Iron Regulated Surface Determinant B (IsdB) With Functional Activity In Vitro and In Vivo," Human Antibodies 19(4): 113-28 (2010); Pancari et al., "Characterization of the Mechanism of Protection Mediated by CS-D7, a Monoclonal Antibody to Staphylococcus aureus Iron Regulated Surface Determinant B (IsdB)," Frontiers in Cellular and Infection Microbiology 2(36): 1-13 (2012), which are hereby incorporated by reference in their entirety), the immunoglobulin-G binding protein Protein-A, lipoteichoic acid (Weisman et al., "Phase 1/2 Double-Blind, Placebo-Controlled, Dose Escalation, Safety, and Pharmacokinetic Study of Pagibaximab (BSYX-A110), an Antistaphylococcal Monoclonal Antibody for the Prevention of Staphylococcal Bloodstream Infections, in Very-Low-Birth-Weight Neonates," *Antimicrob Agents & Chemotherapy* 53(7):2879-86 (2009), which is hereby incorporated by reference in its entirety) or an uncharacterized *S. aureus* cell surface antigen (mAb CR6526-based FN3 fusion protein). As controls, the anti-RSV V-region derived from CNTO3930 that targets the respiratory syncytial virus F (RSV-F) protein was included in the context of both a mAb-FN3 fusion protein and as an isotype IgG1 control antibody, CNTO3930.

Procedure.

Female 5-6 week old Swiss Webster ND4 mice (Harlan Laboratories, Indianapolis, Ind.) were administered test articles (8 per group) via intra-peritoneal (IP injection) 24 hours prior to infection. Mice were subsequently infected with a pre-determined fixed concentration (~10^6 Log 10 CFU per mouse) of *S. aureus* Newman (Baba et al., "Genome Sequence of *Staphylococcus aureus* Strain Newman and Comparative Analysis of Staphylococcal Genomes: Polymorphism and Evolution of Two Major Pathogenicity Islands," *J Bacteriol.* 190(1):300-310 (2008), which is hereby incorporated by reference in its entirety) injected in a 100 µL volume retro-orbitally (under isoflurane anesthesia) using a 28 G, ½ inch needle. The administered concentration corresponds to the lowest bacterial inoculum that typically yields a robust kidney infection as defined by the resulting bacterial burden. Bacterial burden is determined by colony forming units (CFUs) measured from homogenates of explanted kidneys and the visual observation and enumeration of kidney surface lesions. In all cases, test articles were administered 24 hours prior to infection and mice euthanized and kidneys harvested 96 hour post infection. Kidneys were scored for severity of infection via visual lesion count. The kidneys were then explanted, weighed, homogenized, and the resulting homogenates serially diluted and plated on bacterial growth media (Tryptic Soy Agar (TSA)) to determine terminal viable bacterial burdens per individual kidneys via the CFU endpoint. Mice were monitored daily for health observations. The kidney severity abscess score was recorded as: 1-2 visible lesions=severity score 1, 3-9 visible lesions=severity score 2, and >=10 visible lesions=severity score 3. Statistical analysis of both the lesion data and bacterial burden (CFU) data was performed by calculating p-values using the Dunn's Method. Test articles evaluated were CNTO3930 (Construct 21 in Table 1; SEQ ID NO:104 HC plus SEQ ID NO:105 LC), mAb 5133 PRASA A6 (Construct 4 in Table 1; SEQ ID NO:66 HC plus SEQ ID NO:67 LC), ProA3 PRASA A6 HC-L4-E-L4-AB (Construct 16 in Table 1; SEQ ID NO:HC 868 plus SEQ ID NO:841 LC), ProA9 PRASA A6 HC-L4-E-L4-AB (Construct 17 in Table 1; SEQ ID NO:HC 880 plus SEQ ID NO:842 LC), IsdB PRASA A6 HC-L4-E-L4-AB (Construct 18 in Table 1; SEQ ID NO:HC 921 plus SEQ ID NO:844 LC), mAb 6526 PRASA A6 HC-L4E-L4-AB (Construct 23 in Table 1; SEQ ID NO:HC 923 plus SEQ ID NO: 845 LC), RSV PRASA A6 HC-L4-E (Construct 20 in Table 1; SEQ ID NO:927 HC plus SEQ ID NO:843 LC), LTA PRASA A6 HC-L4E-L4-AB (Construct 19 in Table 1; SEQ ID NO:HC 925 plus SEQ ID NO:846 LC) and mAb 5133 PRASA A6 HC-L4-E-L4-AB (Construct 11 in Table 1; SEQ ID NO:856 HC plus SEQ ID NO:67 LC). All test articles were administered IP at a dose of 500 µg per animal 24-hours prior to infection.

Results.

Figure 7A:
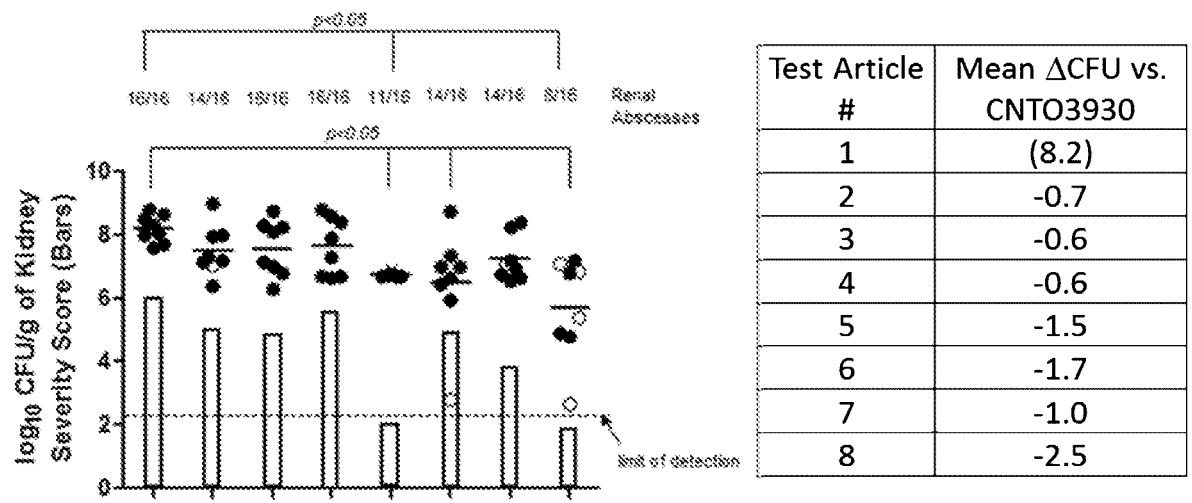
FIGS. 7A-7B are graphs showing that mAb 5133 and mAb 5133-FN3 fusion proteins exhibit enhanced therapeutic efficacy in a mouse renal abscess infection model over mAbs or mAb-FN3 fusion proteins targeting non-SDR adhesin protein antigens.
Figure 7B:
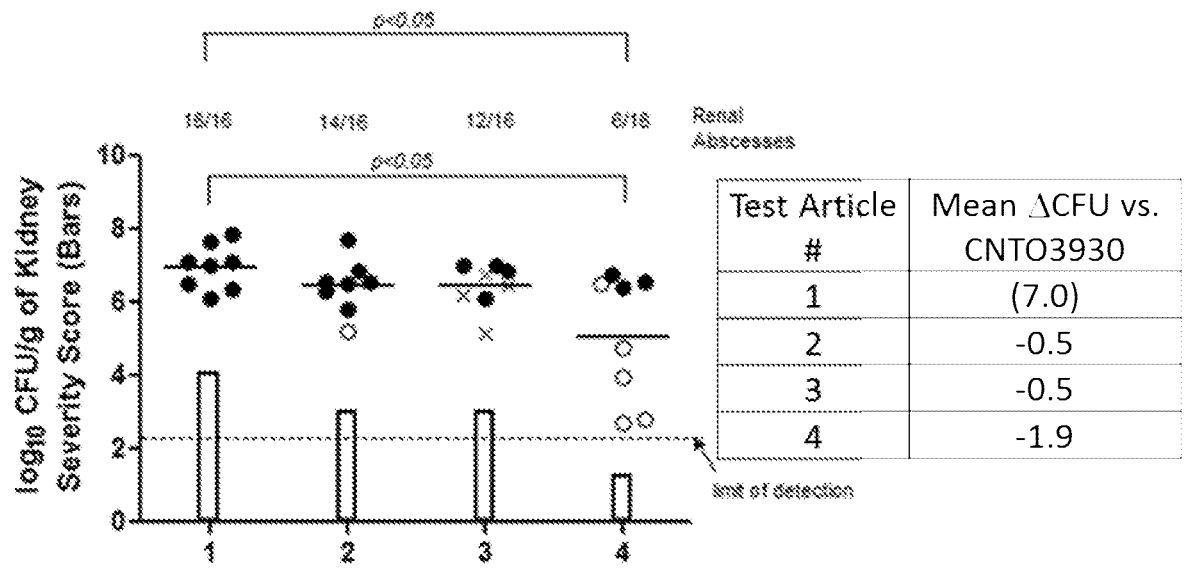

FIG. 7 shows the reductions in kidney severity scores, the total kidney surface lesions per group and the viable bacterial burdens per individual kidneys recovered for each dosed animal. As expected, treatment with the isotype control anti-RSV antibody (CNTO3930, Lane 1 in FIGS. 7A and 7B) resulted in the highest mean bacterial burden in the kidneys with a mean log 10 CFU/g kidney of 8.2 (FIG. 7A) or 7.0 (FIG. 7B) and with visual evidence of lesions on each kidney harvested from the group of eight animals (16/16). Treatment with mAb 5133 PRASA A6 (Lane 2 in FIGS. 7A and 7B), reduced the bacterial burden in the kidney by minus 0.5-0.7 log 10 CFU/g compared to CNTO3930 and lowered kidney abscess lesion incidence to 87.5% (14/16). Treatment with mAb-FN3 fusion proteins which differ only in their V-region component but are otherwise identical in their anti-toxin FN3 components as fused to the heavy chain of the mAb entity resulted in efficacy enhanced over mAb 5133 PRASA A6 only in some specific cases. Specifically, treatment with mAb-FN3 fusion targeting staphylococcal antigens Protein-A (Lanes 3 & 4 in FIG. 7A) or LTA (Lane 3 in FIG. 7B) resulted in minimal if any enhancement in efficacy as evidenced by kidney surface lesions per group and the viable bacterial burdens per individual kidneys recovered for each dosed animal. In contrast, mAb-FN3 fusion proteins targeting either IsdB (Lane 5 in FIG. 7A), the unknown surface antigen of mAb 6526 (Lane 6 in FIG. 7A) or glycosylated forms of the SDR family of adhesin proteins (Lane 8 in FIG. 7A and Lane 4 of FIG. 7B) exhibited efficacy significantly improved over the other mAb-FN3 fusion proteins and mAb 5133 PRASA A6. Of these, the mAb 5133-based mAb-FN3 fusion protein targeting the SDR family of adhesin proteins (mAb 5133 PRASA A6 HC-L4-E-L4-AB; Construct 11 in Table 1) was the most efficacious of all reducing the bacterial burden in the kidney by minus 1.9 to 2.5 $\log_{10}$ CFU/g compared to CNTO3930 and reducing kidney lesion incidence by 50 to 62.5% (8/16 to 6/16).

Summary.

These data support show that the V-region target of mAb 5133 and mAb 5133-based FN3 fusion proteins affords efficacy improved over other anti-staphylococcal mAbs and mAb-FN3 fusion proteins targeting different *S. aureus* surface-expressed antigens including Protein-A, lipoteichoic acid, Iron Sulfur Determinant B (IsdB) and that targeted by mAb CR-6526.

Example 8: The Efficacy of mAb5133 and mAb 5133-FN3 Fusion Proteins is Enhanced in the Presence of Sub-Therapeutic Concentrations of Vancomycin in a Mouse Kidney Infection Model Patients with serious, diagnosed *S. aureus* infections that may benefit clinically from administration of an anti-staphylococcal biologic agent will likely be receiving antibiotic therapy. Hence, it is of interest to understand whether the co-administration of an anti-staphylococcal biologic agent either interferes with antibiotic activity, has no impact, or possibly enhances antibiotic effectiveness. To address this, a series of biologic test articles were administered to mice in the context of sub-therapeutic doses of the commonly used, first-line anti-MRSA antibiotic, vancomycin, and efficacy assessed in a mouse renal (kidney) infection model of disease. As an isotype IgG1 control, non-antistaphylococcal antibody, CNTO3930 (SEQ ID NO: 104 HC plus SEQ ID NO: 105 LC) was employed that targets the respiratory syncytial virus F (RSV-F) protein.

Procedure.

Female 5-6 week old Swiss Webster ND4 mice (Harlan Laboratories, Indianapolis, Ind.) were administered test articles (8 per group) via intra-peritoneal (IP injection) 24 hours prior to infection. Mice were subsequently infected with a pre-determined fixed concentration (~10^6 Log 10 CFU per mouse) of *S. aureus* Newman (Baba et al., "Genome Sequence of *Staphylococcus aureus* Strain Newman and Comparative Analysis of Staphylococcal Genomes: Polymorphism and Evolution of Two Major Pathogenicity Islands," *J. Bacteriol.* 190(1):300-310 (2008), which is hereby incorporated by reference in its entirety), injected in a 100 μL volume retro-orbitally (under isoflurane anesthesia) using a 28 G, ½ inch needle. The administered concentration corresponds to the lowest bacterial inoculum that typically yields a robust kidney infection as defined by the resulting bacterial burden. Bacterial burden is reflected by determinations of colony forming units (CFUs) measured from homogenates of explanted kidneys and the visual observation and enumeration of kidney surface (abscess) lesions. In all cases, test articles were administered 24 hours prior to infection and mice euthanized and kidneys harvested 96 hour post infection. Kidneys were scored for severity of infection via visual lesion count. The kidneys were then explanted, weighed, homogenized, and the resulting homogenates serially diluted and plated on bacterial growth media (Tryptic Soy Agar (TSA)) to determine terminal viable bacterial burdens per individual kidneys via the CFU endpoint. Mice were monitored daily for health observations. Statistical analysis of both the lesion data and bacterial burden (CFU) data was performed by calculating p-values using the Dunn's Method. Test articles evaluated were CNTO3930 (Construct 21 in Table 1; SEQ ID NO:104 HC plus SEQ ID NO:105 LC), mAb 5133 PRASA (Construct 2 in Table 1; SEQ ID NO: 62 HC plus SEQ ID NO:63 LC), mAb 5133 PRASA A6 HC-L4-E (Construct 15 in Table 1; SEQ ID NO:848 plus SEQ ID NO:71 LC) and mAb 5133 PRASA A6 HC-L4-E-L4-AB (Construct 11 in Table 1; SEQ ID NO:856 HC plus SEQ ID NO:67 LC). All test articles were administered IP at a dose of 500 μg per animal 24-hours prior to infection. Where administered, vancomycin was dosed at 3.125 mgs/kg IP one and three hours post-infection.

Results.

Figure 8:
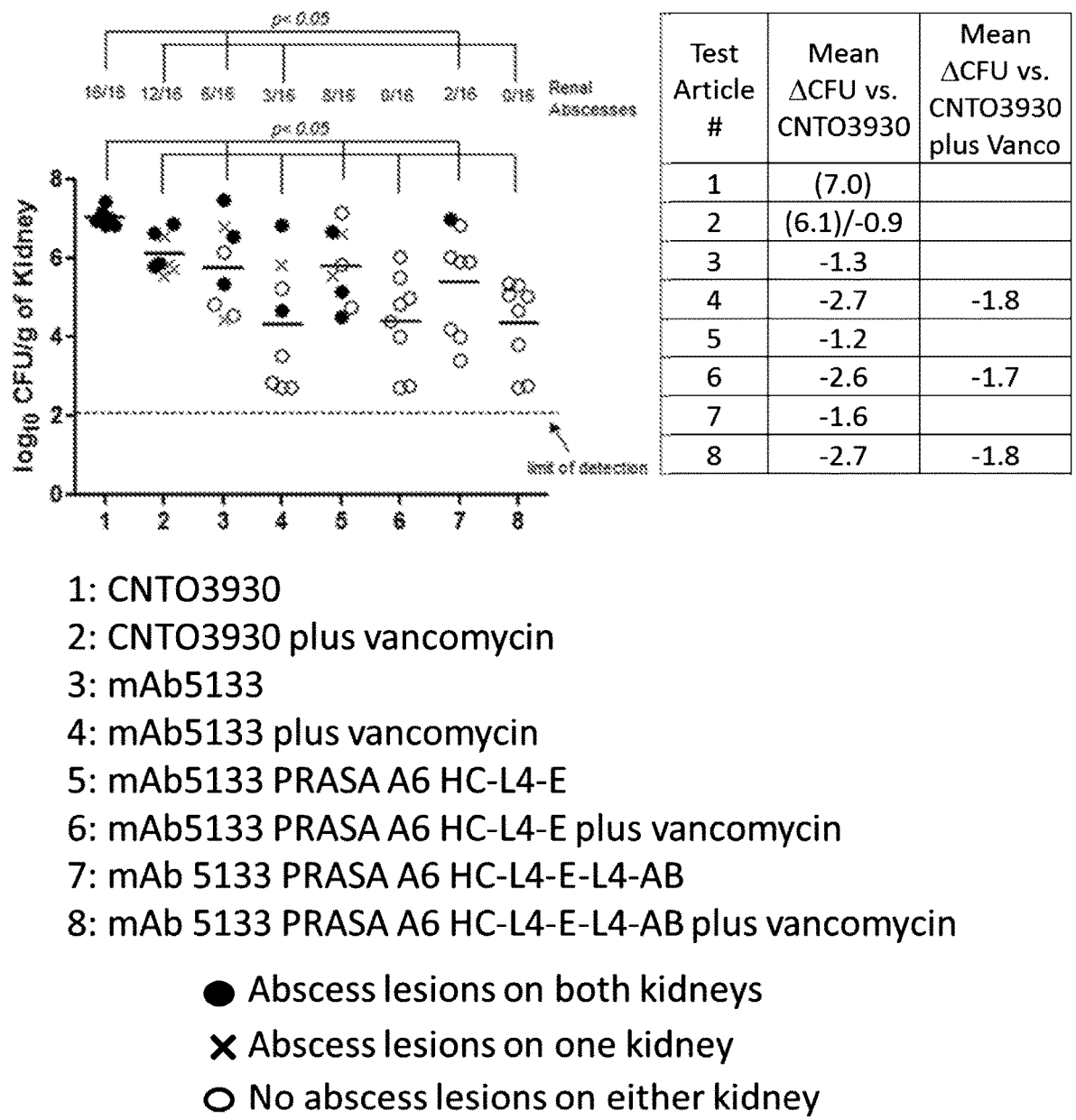
FIG. 8 is a graph showing that the efficacy of mAb5133 and mAb 5133-FN3 fusion proteins is enhanced in the presence of sub-therapeutic concentrations of vancomycin in a mouse kidney infection model.

FIG. 8 shows the reduction in total kidney surface lesions per group and the viable bacterial burdens per individual kidneys recovered for each dosed animal. As expected, treatment with the isotype control anti-RSV antibody (CNTO3930, FIG. 8, Lane 1) resulted in the highest mean bacterial burden in the kidneys with a mean log 10 CFU/g kidney of 7.0 and with visual evidence of lesions on each kidney harvested from the group of eight animals (16/16). Combination of a sub-therapeutic dose of vancomycin (3.125 mgs/kg one and three hours post-infection) with CNTO3930 resulted in enhanced efficacy with lesion score reduced to 75% (12/16) and mean bacterial burden reduced by minus 0.9 log 10 CFU/g kidney (FIG. 8, Lane 2). Treatment with mAb 5133 PRASA (FIG. 8, Lane 3) resulted in a reduction in bacterial burden in the kidneys with a mean log 10 CFU/g kidney of minus 1.3 compared to CNTO3930 and a reduction in kidney lesions to 37.5% (6/16) compared to CNTO3930. Combination of a sub-therapeutic dose of vancomycin (3.125 mgs/kg one and three hours post-infection) with mAb513 PRASA resulted in enhanced efficacy with lesion score reduced to 18.75% (3/16) and mean bacterial burden reduced by minus 1.8 or 2.7 log 10 CFU/g kidney (FIG. 8, Lane 4) compared to CNTO3930 and CNTO3930 plus vancomycin, respectively. Treatment with the mAb-FN3 fusion protein mAb 5133 PRASA A6 HC-L4-LukE protein (FIG. 8, Lane 5) resulted in a reduction in bacterial burden in the kidneys with a mean log 10 CFU/g kidney of minus 1.2 compared to CNTO3930 and a reduction in kidney lesions to 50% (8/16) compared to CNTO3930. Combination of a sub-therapeutic dose of vancomycin (3.125 mgs/kg one and three hours post-infection) with mAb 5133 PRASA A6 HC-L4-LukE resulted in further enhanced efficacy with no apparent kidney lesions (0/16) and mean bacterial burden reduced by minus 1.7 or 2.6 log 10 CFU/g kidney (FIG. 8, Lane 6) compared to CNTO3930 and CNTO3930 plus vancomycin, respectively. Treatment with the mAb-FN3 fusion protein mAb 5133 PRASA A6 HC-L4-LukE-L4-LukAB protein (FIG. 8, Lane 7) resulted in a reduction in bacterial burden in the kidneys with a mean log 10 CFU/g kidney of minus 1.6 compared to CNTO3930 and a reduction in kidney lesions to 12.5% (2/16) compared to CNTO3930. Finally, combination of a sub-therapeutic dose of vancomycin (3.125 mgs/kg one and three hours post-infection) with mAb 5133 PRASA A6 HC-L4-LukE-L4-LukAB resulted in further enhanced efficacy with no apparent kidney lesions (0/16) and mean bacterial burden reduced by minus 1.8 or 2.7 log 10 CFU/g kidney (FIG. 8, Lane 8) compared to CNTO3930 and CNTO3930 plus vancomycin, respectively.

Summary.

These data show that biologic agents that target glycosylated forms of the SDR family of adhesin proteins and neutralize leukotoxins LukAB and LukED may be used in combination with standard-of-care antibiotic agents like vancomycin to afford enhanced therapeutic benefit for patients diagnosed with serious *S. aureus* infections.

Example 9: Improved Efficacy of mAb 5133-FN3 Fusion Proteins Compared to mAb-5133 in a Mouse Bacteremia Model In understanding the relative contributions of the V-region and/or the anti-leukotoxin FN3 components of mAb 5133-based FN3 fusion proteins with regard to efficacy in animal models of human *S. aureus* infections, a series of test articles were compared for their relative efficacy in a mouse model of bacteremia disease. Specifically, a series of test articles were evaluated "head-to-head" that bear the same mAb 5133-derived V-region (targeting glycosylated forms of the SDR family of adhesins) but differ in their FN3 domain composition. As an isotype IgG1 control, non-antistaphylococcal antibody, CNTO3930 (SEQ ID NO: 104 HC plus SEQ ID NO: 105 LC) was employed that targets the respiratory syncytial virus F (RSV-F) protein.

Procedure.

Female 5-6 week old Swiss Webster ND4 mice (Harlan Laboratories, Indianapolis, Ind.) were administered test articles (4-8 per group) via the retro-orbital (RO) route in a fixed dose volume of 100 μL/mouse 4 hours prior to infection. Mice were subsequently infected with a fixed concentration ($1\times10^{5.4}$ $Log_{10}$ CFU per mouse) of *S. aureus* Newman injected in a 200 μL volume via the intra-peritoneal (IP) route using a 27 G, ½ inch needle. Two hours later, mice were euthanized by $CO_2$ asphyxiation and immediately bled by cardiac puncture into lithium heparin tubes and neat blood plus serial dilutions in phosphate buffered saline (PBS) immediately plated on Tryptic Soy Agar (TSA) plates. Then 2-5 mLs of sterile saline was injected via the intra-peritoneal (IP) route, gently mixed by inverting the mouse several times, and the peritoneal fluid collected by opening the peritoneum and withdrawing the fluid using a 1 cc syringe. After collecting the peritoneal fluid, the spleen was collected, weighed, and homogenized. Spleen homogenates and the peritoneal fluid were serially diluted with sterile saline and plated on bacterial growth media (TSA) to determine the terminal viable bacterial burdens in both peritoneal fluid and spleens. Statistical analysis was performed by unpaired t-test using GraphPad Prism, version 5.0. Test articles evaluated were CNTO3930 (Construct 21 in Table 1; SEQ ID NO:104 HC plus SEQ ID NO:105 LC), mAb 5133 PRASA A6 (Construct 4 in Table 1; SEQ ID NO:66 HC plus SEQ ID NO:67 LC), mAb 5133 PRASA A6 HC-L4-E-L1-AB (Construct 12 in Table 1; SEQ ID NO: 952 HC plus SEQ ID NO:67 LC), mAb 5133 PRASA A6 HC-L4-E-L1-AB-FLAG (Construct 13 in Table 1; SEQ ID NO:965 HC plus SEQ ID NO:63 LC), mAb 5133 PRASA A6 HC-L4-E-L4-AB-FLAG (Construct 14 in Table 1; SEQ ID NO:970 HC plus SEQ ID NO:63 LC) and mAb 5133 PRASA A6 HC-L4-E-L4-AB (Construct 11 in Table 1; SEQ ID NO:856 HC plus SEQ ID NO:67 LC). All test articles were administered RO at a dose of 500 μg per animal.

Results.

Figure 9:
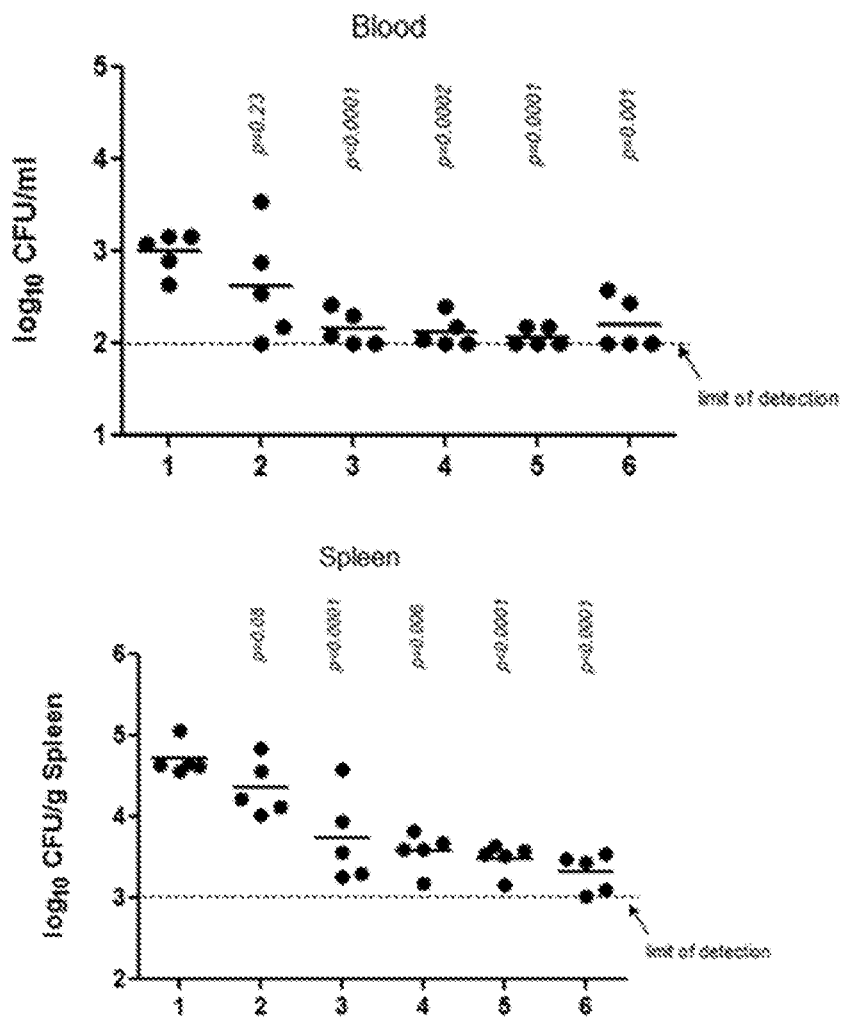
FIG. 9 is a graph showing improved efficacy of mAb 5133-FN3 fusion proteins compared to mAb-5133 alone in a mouse bacteremia model. The top panel of FIG. 9 shows the amount of colony forming units present in blood of mice infected with *S. aureus* and administered the identified antibody or antibody-FN3 fusion construct. The bottom panel of FIG. 9 is depicts the amount of colony forming units present in the spleen of mice infected with *S. aureus* and administered the identified antibody or antibody-FN3 fusion construct.

FIG. 9 shows the reduction in viable bacterial burden in the blood and spleen per individual animal. As expected, treatment with the isotype control anti-RSV antibody (CNTO3930, FIG. 9, Lane 1) resulted in the highest mean bacterial burden in both the blood (FIG. 9, top panel) and spleen (FIG. 9, bottom panel). Treatment with mAb 5133 PRASA A6 (FIG. 9, Lane 2), reduced the bacterial burden in both the blood and spleen, but this reduction was not significant relative to CNTO3930 treatment with calculated p values of 0.23 and 0.08 for blood and spleen, respectively. In contrast, treatment with all mAb 5133-based FN3 fusion proteins targeting LukE and LukAB (FIG. 9, Lanes 3, 4, 5 and 6) resulted in reductions in bacterial burden in both the blood (top panel) and spleen (bottom panel) compared to CNTO3930 with calculated p values in the 0.006 to 0.0001 range.

Summary.

These data show that mAb 5133-FN3 fusion proteins that target glycosylated forms of the SDR family of adhesin proteins and neutralize leukotoxins LukAB and LukED may have therapeutic utility in the treatment of *S. aureus* mediated bacteremia.

Example 10: Improved Efficacy of mAb 5133-FN3 Fusion Proteins Compared to the Sum of its Composite Parts In understanding the relative contributions of the V-region and/or the anti-toxin FN3 components of mAb 5133-based FN3 fusion proteins with regard to efficacy in animal models of human *S. aureus* infections, a series of test articles were compared for their relative efficacy in a mouse renal (kidney) infection model of disease. Specifically, a series of test articles were evaluated "head-to-head" that bear the same mAb 5133-derived V-region (targeting glycosylated forms of the SDR family of adhesins) but differ in their FN3 domain composition. As an isotype IgG1 control, non-antistaphylococcal antibody, CNTO3930 (SEQ ID NO: 104 HC plus SEQ ID NO: 105 LC) was employed that targets the respiratory syncytial virus F (RSV-F) protein.

Procedure.

Female 5-6 week old Swiss Webster ND4 mice (Harlan Laboratories, Indianapolis, Ind.) were administered test articles (8 per group) via intra-peritoneal (IP) injection in a fixed dose volume of 200 μL/mouse 24 hours prior to infection. Mice were subsequently infected with a predetermined fixed concentration (~6.8×10^6 $Log_{10}$ CFU per mouse) of *S. aureus* Newman (Baba et al., "Genome Sequence of *Staphylococcus aureus* Strain Newman and Comparative Analysis of Staphylococcal Genomes: Polymorphism and Evolution of Two Major Pathogenicity Islands," *J. Bacteriol.* 190(1):300-310 (2008), which is hereby incorporated by reference in its entirety) injected in a 100 μL volume retro-orbitally (under isoflurane anesthesia) using a 28 G, ½ inch needle. This infectious dose corresponds to the lowest bacterial inoculum that typically yields a robust kidney infection as defined by the resulting bacterial burden. In all cases, test articles were administered 24 hours prior to infection and mice euthanized and kidneys harvested 96 hour post infection. Mice were monitored daily for health observations. Kidneys were scored for severity of infection via visual lesion (abscess) count with the aid of a dissecting microscope, and then explanted, weighed, homogenized, and the resulting homogenates serially diluted and plated on bacterial growth media (Tryptic Soy Agar (TSA)) to determine terminal viable bacterial burdens per individual kidney via the CFU endpoint. The kidney severity abscess score was recorded as: 1-2 visible lesions=severity score 1, 3-9 visible lesions=severity score 2, and >=10 visible lesions=severity score 3. Mice were monitored daily for health observations. Statistical analysis of both the lesion data and bacterial burden (CFU) data was performed by calculating p-values using the Dunn's Method. Test articles evaluated were CNTO3930 (Construct 21 in Table 1; SEQ ID NO:104 HC plus SEQ ID NO:105 LC), mAb 5133 PRASA A6 (Construct 4 in Table 1; SEQ ID NO:66 HC plus SEQ ID NO:67 LC), mAb 5133 PRASA A6 HC-L4-AB (Construct 6 in Table 1; SEQ ID NO:70 HC plus SEQ ID NO:71 LC), mAb 5133 PRASA A6 HC-L4-E (Construct 15 in Table 1; SEQ ID NO: 848 HC plus SEQ ID NO:71 LC) and mAb 5133 PRASA A6 HC-L4-E-L4-AB (Construct 11 in Table 1; SEQ ID NO:856 HC plus SEQ ID NO:67 LC). All test articles were administered IP at a dose of 250 μg per animal, alone or in combination, 24 hours prior to infection.

Results.

Figure 10:
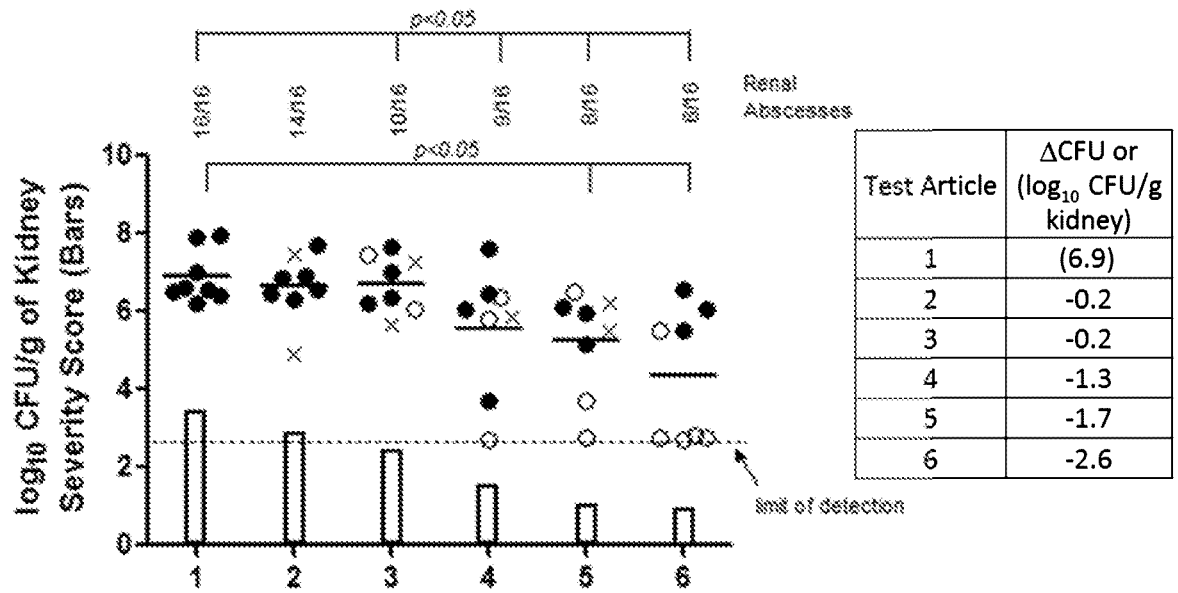
FIG. 10 is a graph showing that the efficacy of mAb 5133-FN3 fusion proteins is improved over the sum of its composite parts in a mouse kidney infection model.

FIG. 10 shows the reductions in kidney severity scores, the total visible kidney surface lesions per group and the viable bacterial burdens per individual kidney recovered for each dosed animal. As expected, treatment with the isotype control anti-RSV antibody (CNTO3930, FIG. 10, Lane 1) resulted in the highest mean bacterial burden in the kidneys with a mean log 10 CFU/g kidney of 6.9 and with the highest visual evidence of lesions on each kidney harvested from the group of eight animals (16/16). Treatment with mAb 5133 PRASA A6 (FIG. 10, Lane 2), reduced the bacterial burden in the kidney by minus 0.2 log 10 CFU/g compared to CNTO3930 and lowered kidney lesion incidence to 87.5% (14/16). Treatment with mAb 5133 PRASA A6 HC-L4-AB (FIG. 10, Lane 3) reduced the bacterial burden in the kidney by minus 0.2 $log_{10}$ CFU/g compared to CNTO3930 and lowered the kidney lesion incidence further to 62.5% (10/16). Treatment with mAb 5133 PRASA A6 HC-L4-E (FIG. 10, Lane 4) reduced the bacterial burden in the kidney by minus 1.3 $log_{10}$ CFU/g compared to CNTO3930 and lowered the kidney lesion incidence further to 56.25% (9/16). Combination of mAb 5133 PRASA A6 HC-L4-AB with mAb 5133 PRASA A6 HC-L4-E (FIG. 10, Lane 5), each dosed at 250 μg/animal (500 μg total per animal), further reduced the bacterial burden in the kidney by minus 1.7 $log_{10}$ CFU/g compared to CNTO3930 and lowered the kidney lesion incidence further to 50% (8/16). However, treatment with mAb 5133 PRASA A6 HC-L4-E-L4-AB (Lane 6) afforded maximal efficacy dosed at 250 µg/animal with the bacterial burden in the kidney reduced by minus 2.6 $\log_{10}$ CFU/g compared to CNTO3930 and lowering of the kidney lesion incidence to 37.5% (6/16).

Summary.

These data show that mAb 5133-FN3 fusion proteins bearing a tandem appendage of FN3 domains targeting both the leukotoxins ED and AB confer efficacy in this mouse model of kidney infection that is enhanced over mAb 5133-FN3 fusion proteins individually targeting leukotoxins ED and AB. Further, the efficacy of mAb 5133 PRASA A6 HC-L4-E-L4-AB dosed at 250 µg/animal is enhanced over the efficacy of mAb 5133 PRASA A6 HC-L4-AB dosed in combination with mAb 5133 PRASA A6 HC-L4-E (each dosed at 250 µg/animal) in support of the notion that the efficacy of mAb 5133 PRASA A6 HC-L4-E-L4-AB is improved over the sum of its composite parts (mAb 5133 PRASA A6 HC-L4-AB and mAb 5133 PRASA A6 HC-L4-E).

Example 11: Improved Efficacy of mAb 5133-FN3 Fusion Proteins Compared to mAb5133 in a Mouse Skin Infection Model In understanding the relative contributions of the V-region and/or the anti-toxin FN3 components of mAb 5133-based FN3 fusion proteins with regard to efficacy in animal models of human *S. aureus* infections, a series of test articles were compared for their relative efficacy in a mouse model of skin infection. Specifically, a series of test articles were evaluated "head-to-head" that bear the same mAb 5133-derived V-region (targeting glycosylated forms of the SDR family of adhesins) but differ in their FN3 domain composition. As an isotype IgG1 control, non-antistaphylococcal antibody, CNTO3930 (SEQ ID NO: 104 HC plus SEQ ID NO: 105 LC) was employed that targets the respiratory syncytial virus F (RSV-F) protein.

Procedure.

These studies employed SKH-1 Elite mice (Charles River Laboratories, Wilmington, Mass.) which are an outbred hairless, immunocompetent strain. Female 8-10 weeks old mice were administered test articles (8 per group) via intra-peritoneal (IP) injection in a fixed dose volume of 200 µL/mouse 4 hours before or after infection. Mice were subsequently infected under isoflurane anesthesia with a pre-determined fixed concentration (~$6.6 \times 10^6$ Log 10 CFU per mouse) of *S. aureus* MRSA strain JE2 (Fey et al., "A Genetic Resource for Rapid and Comprehensive Phenotype Screening of Nonessential *Staphylococcus aureus* Genes," *mBio* 4(1):e00537-12 (2013), which is hereby incorporated by reference in its entirety) as a 0.1% suspension of dextrin microcarrier beads (Cytodex 1®, Sigma-Aldrich Chemical Company, St. Louis, Mo.) in a 200 µL volume by subcutaneous (SC) injection with a 27 G, ½ inch needle. Three days after infection, animals were euthanized by $CO_2$ asphyxiation. Skin lesions were measured (length and width) by electronic digital caliper (Mitutoyo Corporation, Aurora, Ill.) and the corresponding skin was aseptically collected, serially diluted in sterile saline, and plated on TSA plates to determine bacterial burden. A lesion volume score was calculated from the following equation: LV=($\pi$/6)(L×W2), where LV=lesion volume, L=length of the lesion in mm, and W=width of the lesion in mm (Bunce et al., *Infect and Immunity*, 60:2636-2640 (1992), which is hereby incorporated by reference in its entirety). Statistical analysis performed by unpaired t-test using GraphPad Prism, version 5.0. Test articles evaluated were CNTO3930 (Construct 21 in Table 1; SEQ ID NO: 104 HC plus SEQ ID NO: 105 LC), mAb 5133 PRASA A6 (Construct 4 in Table 1; SEQ ID NO:66 HC plus SEQ ID NO:67 LC), mAb 5133 PRASA A6 HC-L4-E-L1-AB (Construct 12 in Table 1; SEQ ID NO:952 HC plus SEQ ID NO:67 LC) and mAb 5133 PRASA A6 HC-L4-E-L4-AB (Construct 11 in Table 1; SEQ ID NO:856 HC plus SEQ ID NO:67 LC). All test articles were administered IP at a dose of 500 µg per animal.

Results.

Figure 11A:
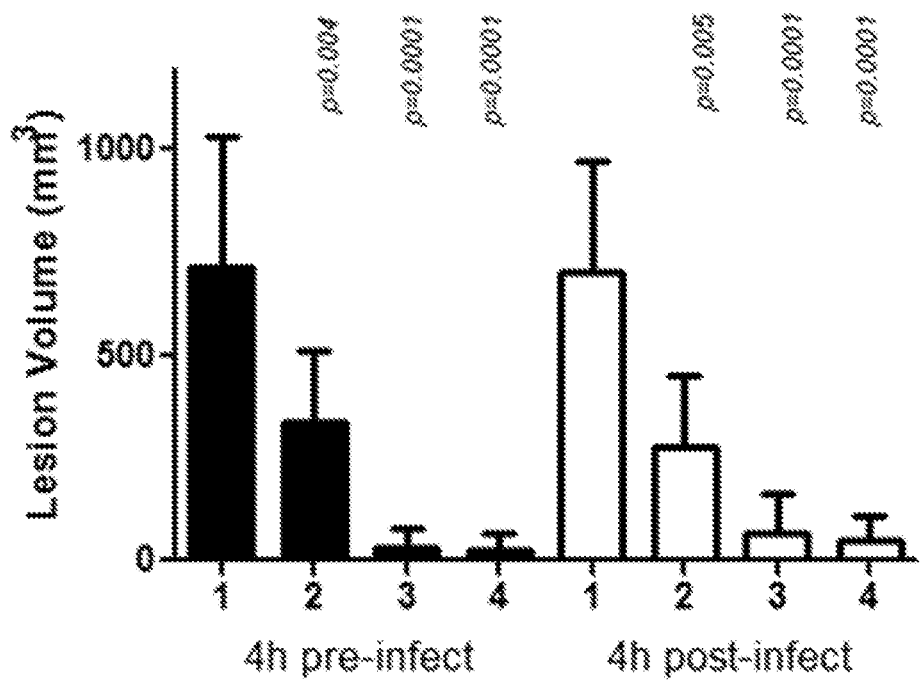
FIGS. 11A-11B are graphs showing that the efficacy of mAb 5133-FN3 fusion proteins is improved over mAb-5133 in a mouse skin infection model as assessed by skin lesion volume (FIG. 11A) and bacterial burden in the skin lesion (FIG. 11B).
Figure 11B:
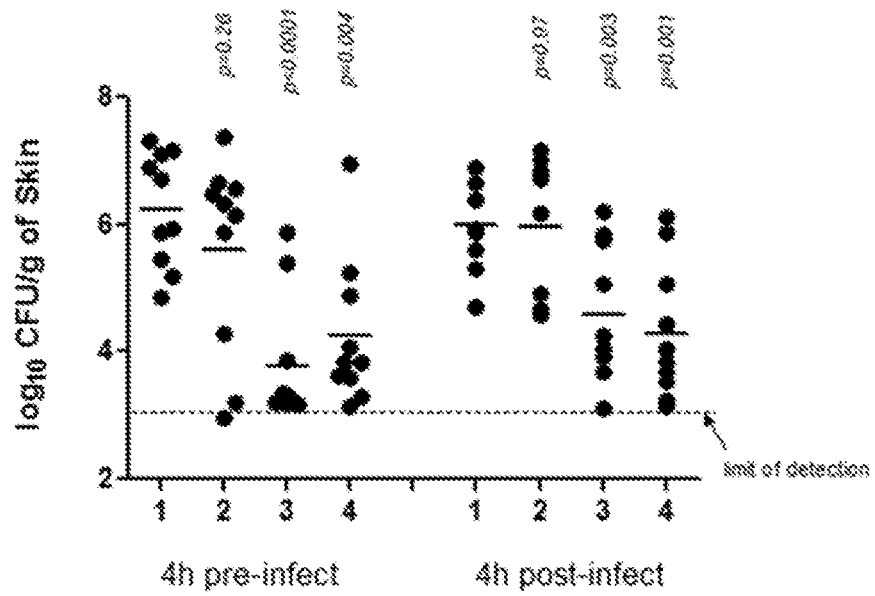

FIG. 11 shows the efficacy of the evaluated test articles in this mouse model of human *S. aureus* skin infections as assessed by skin lesion volume (FIG. 11A) or bacterial burden in skin lesions (FIG. 11B) when dose either 4 hours prior to or 4 hours after infection. As expected, treatment with the isotype control anti-RSV antibody (CNTO3930, Lane 1) resulted in the largest mean skin lesion volumes (FIG. 11A) and highest bacterial burden in skin lesions (FIG. 11B) corresponding to 6.0 to $6.2 \times \log_{10}$ CFU/g of skin. Treatment with mAb 5133 PRASA A6 (Lane 2), significantly reduced the mean skin lesion volume compared to CNTO3930 with a calculated p values of 0.004 to 0.005 (FIG. 11A, lanes 3 and 4) but while the bacterial burden in skin lesions (FIG. 11B, lanes 3 and 4) was reduced by minus 0.8 and 0.1 $\log_{10}$ CFU/g when dosed pre- and post-infection, respectively, the efficacy observed was not considered statistically significant when compared to the efficacy observed with CNTO3930 (p values 0.26 and 0.96). In contrast, treatment with both mAb5133-based FN3 fusion proteins resulted in statistically significant reductions in both skin lesion volumes (FIG. 11A) and bacterial burden in skin lesions (FIG. 11B) compared to CNTO3930 when dosed either 4 hour pre- or 4 hours post-infection with calculated p values in the range 0.003 to 0.0001.

Summary.

These data indicate that mAb 5133-FN3 fusion proteins that target glycosylated forms of the SDR family of adhesin proteins and neutralize leukotoxins LukAB and LukED in exposed skin tissue, indicating therapeutic utility in the treatment of *S. aureus* mediated skin infections.

Example 12: mAb5133-FN3 Fusion Proteins Provide Improved Protection from Staphylococcal Mediated Extracellular Killing of Primary Human Neutrophils Leukotoxins are capable of killing key classes of human immune cells, including neutrophils both from the outside of the cell via a process triggered by engagement with specific receptors on the immune cell surface and are also capable of killing from the inside of the cell through leukotoxin-mediated escape from the phagolysosome (Alonzo and Torres, "The Bicomponent Pore-forming Leucocidins of *Staphylococcus aureus*," *Microbiol Mol Biol Rev.* 78(2): 199-230 (2014), which is hereby incorporated by reference in its entirety). The studies described herein exemplify the ability of mAb5133-FN3 fusion proteins that bind and neutralize leukotoxins LukED and LukAB to afford protection of primary human neutrophils from extracellular killing mediated by a *S. aureus* USA 300 CA-MRSA strain BK18807 (Kennedy et al., "Epidemic Community-associated Methicillin-resistant *Staphylococcus aureus*: Recent Clonal Expansion and Diversification," *Proc. Natl. Acad. Sci. U.S.A* 105:1327-1332 (2008), which is hereby incorporated by reference in its entirety). As an isotype IgG1 control, non-antistaphylococcal antibody, CNTO3930 (SEQ ID No: 104 HC plus SEQ DI NO: 105 LC) was employed that targets the respiratory syncytial virus F (RSV-F) protein Procedure.

S. aureus BK18807 was grown overnight in RPMI+CAS medium and then sub-cultured 1:100 in RPMI+CAS and grown for a further 5 hours. The culture was thereafter normalized to $1\times10^9$ CFU/mL with RPMI+CAS. The bacterial suspension (85 μL) (~$8.5\times10^7$ CFU) was then mixed with 180 μL of a 2.5 mg/mL stock concentration of each test article (450 μg each) and 455 μL of RPMI+10 mM HEPES added to yield a final volume of 720 μL. 96-well plates were coated with 20% human serum for 20 mins at 37 C.°+5% $CO_2$ and then washed twice with RPMI plus 10 mM HEPES and 0.1% HSA (RPMI-HH). 80 μl of a freshly purified human primary polymorphonuclear leukocytes (PMNs) were then added to each test well corresponding to ~250,000 cells per well and the plate incubated at room temperature (RT) for 30 mins. 20 μl of the opsonized suspension of bacteria were then added to each PMN containing well to yield a multiplicity of infection (MOI) of ~10, and the plate incubated for 120 mins at 37 C ° in 5% $CO_2$. Plates were then centrifuged for 5 mins at 1,500 RPM. For assessment of cytolysis by lactate dehydrogenase (LDH) release, 25 μL of the supernatants from each test well were transferred into a new black, clear bottom 96-well plate. 25 μL of CytoTox-ONE™ Assay reagent (Promega) was added and the plate incubated in the dark for 15 mins. CytoTox-ONE™ Assay reagent measures the release of LDH from cells with a damaged membrane via a coupled enzymatic assay that results in the conversion of resazurin into a fluorescent resorufin product detected via plate reading in a spectrometer. These experiments were performed with purified human primary polymorphonuclear leukocytes (PMNs) from six independent donors. Test articles evaluated were CNTO3930 (Construct 21 in Table 1; SEQ ID NO: 104 HC plus SEQ ID NO: 105 LC), mAb 5133 PRASA A6 (Construct 4 in Table 1; SEQ ID NO: 66 HC plus SEQ ID NO: 67 LC), mAb 5133 PRASA A6 HC-L4-E-L4-AB (Construct 11 in Table 1; SEQ ID NO: 856 HC plus SEQ ID NO: 67 LC), mAb 5133 PRASA A6 HC-L4-E-L4-AB-FLAG (Construct 24 in Table 1; SEQ ID NO: 918 HC plus SEQ ID NO: 67 LC), c-Myc-mAb 5133 PRASA A6 HC-L4-E-L4-AB (Construct 25 in Table 1; SEQ ID NO: 919 HC plus SEQ ID NO: 67 LC) and c-Myc-mAb 5133 PRASA A6 HC-L4-E-L4-AB-FLAG (Construct 26 in Table 1; SEQ ID NO: 920 HC plus SEQ ID NO: 67 LC).

Results.

Figure 12:
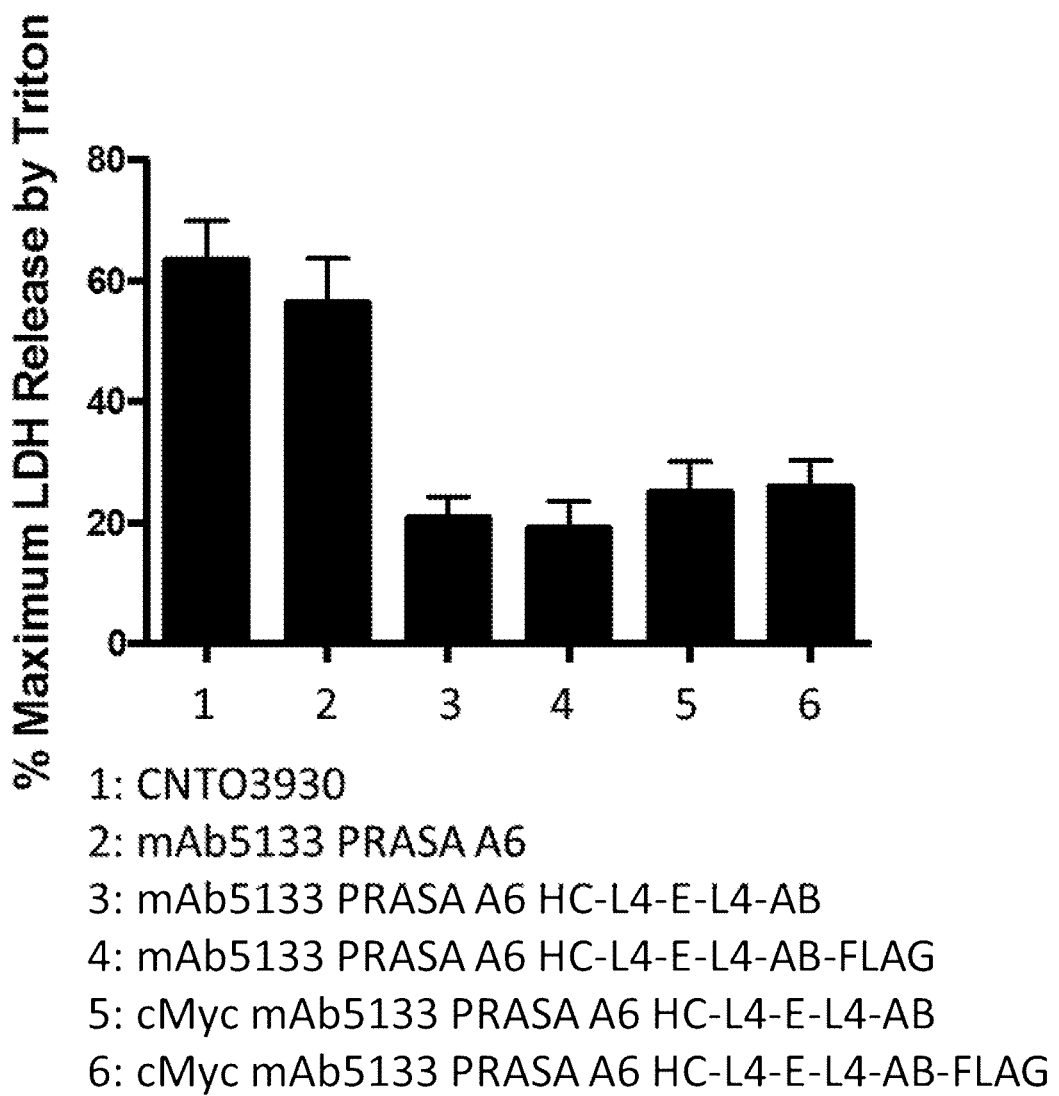
FIG. 12 is a graph showing that the mAb5133-FN3 fusion protein affords protection against *S. aureus* mediated extracellular cytolysis of primary human neutrophils.

FIG. 12 shows the relative impact of pre-incubation of the test articles with S. aureus BK18807 in protecting primary human neutrophils from cytolysis as determined by release of LDH. As expected, CNTO3930 (Lane 1) afforded the least protection as it bears a V-region specific for the RSV-F protein and has no appended FN3 domains capable of binding and neutralizing the cytolytic leukotoxins. Similarly, mAb 5133 (Lane 2) afforded minimal PMN protection indicating that V-region surface engagement of the glycosylated forms of SDR proteins is not significantly protective in this assay. In contrast, all of the four tested mAb5133-FN3 fusion proteins that bear FN3 domains that bind and neutralize LukED and LukAB exhibit maximal PMN protection (Lanes 3 to 6).

Summary.

These data indicate that mAb 5133-FN3 fusion proteins that bind and neutralize the cytolytic activity of leukotoxins LukAB and LukED are capable of protecting human primary neutrophils from leukotoxin-mediated killing. This activity of mAb 5133-FN3 fusion protein targeting LukED and/or LukAB may be of therapeutic utility in the context of S. aureus mediated human infections.

Example 13: mAb5133-FN3 Fusion Proteins Provide Improved Protection from Staphylococcal Mediated Intracellular Killing of Primary Human Neutrophils Leukotoxins are capable of killing key classes of human immune cells, including neutrophils both from the outside of the cell via a process triggered by engagement with specific receptors on the immune cell surface and are also capable of killing from the inside of the cell through leukotoxin-mediated escape from the phagolysosome (Alonzo and Torres, "The Bicomponent Pore-forming Leucocidins of Staphylococcus aureus," Microbiol Mol Biol Rev. 78(2): 199-230 (2014), which is hereby incorporated by reference in its entirety). The studies described herein exemplify the ability of mAb5133-FN3 fusion proteins that bind and neutralize leukotoxins LukED and LukAB to afford protection to primary human neutrophils from intracellular killing mediated by S. aureus USA 300 MRSA strain LAC (Chambers, H. F., "Community-associated MRSA-resistance and Virulence Converge," N. Engl. J. Med. 352:1485-1487 (2005), which is hereby incorporated by reference in its entirety). As an isotype IgG1 control, non-antistaphylococcal antibody, CNTO3930 (SEQ ID NO: 104 HC plus SEQ ID NO: 105 LC) was employed that targets the respiratory syncytial virus F (RSV-F) protein.

Procedure.

S. aureus LAC and a variant deleted for the lukAB genes (LAC ΔLukAB) were grown overnight in RPMI+CAS medium and then sub-cultured 1:100 in RPMI+CAS and grown for a further 5 hours. The cultures were thereafter normalized to $1\times10^9$ CFU/mL with phosphate buffered saline (PBS) and further diluted in PBS in accord with the target multiplicity of infection (MOI). 96-well plates were coated with 20% human serum at 37° C. in 5% $CO_2$ and then washed twice with RPMI+10 mM HEPES. Freshly purified human primary polymorphonuclear leukocytes (PMNs) were re-suspended in RPMI plus 10 mM HEPES and 0.1% HSA (RPMI-HH), was added to each test well corresponding to ~250,000 per well. The plate was incubated at room temperature (RT) for 30 mins. Leukotoxin containing supernatants were prepared as a filtrate of culture supernatant from cultures of S. aureus LAC WT and ΔlukAB grown for 5 hours at 37° C. in RPMI+CAS following a 1:100 dilution of an overnight culture. Opsonization of S. aureus LAC was initiated by combining bacteria at a target MOI of 1.0 ($5\times10^6$ CFU/mL in 23.6 μL), 47.25 μL of filtered S. aureus LAC culture supernatant (as an exogenous source of leukotoxins), 945 μL of 2.5 mg/mL stocks of test article plus 3709.15 mL of RPMI plus 10 mM HEPES to yield a final volume of 4725 μL. Per well, 50 μL of the opsonized bacteria mixture was combined with 50 μL of the fresh PMN suspension and synchronization effected by centrifuging the plates for 1,500 RPM for 7 minutes. Plates were incubated for 120 minutes at 37° C. in 5% $CO_2$. Following incubation, plates were then spun at 1,400 RPM for 7 minutes. For assessment of cytolysis by lactate dehydrogenase (LDH) release, 25 μL of the supernatants from each test well were transferred into a new black, clear bottom 96-well plate. 25 μL of CytoTox-ONE™ Assay reagent (Promega) was added and the plate was incubated in the dark for 15 mins. CytoTox-ONE™ Assay reagent measures the release of LDH from cells with a damaged membrane via a coupled enzymatic assay that results in the conversion of resazurin into a fluorescent resorufin product detected via plate reading in a spectrometer. These experiments were performed with purified human primary polymorphonuclear leukocytes (PMNs)

from six independent donors. Test articles evaluated were CNTO3930 (Construct 21 in Table 1; SEQ ID NO: 104 HC plus SEQ ID NO: 105 LC), mAb 5133 PRASA A6 (Construct 4 in Table 1; SEQ ID NO: 66 HC plus SEQ ID NO: 67 LC) and mAb 5133 PRASA A6 HC-L4-E-L4-AB (Construct 11 in Table 1; SEQ ID NO: 856 HC plus SEQ ID NO: 67 LC).

Results.

Figure 13:
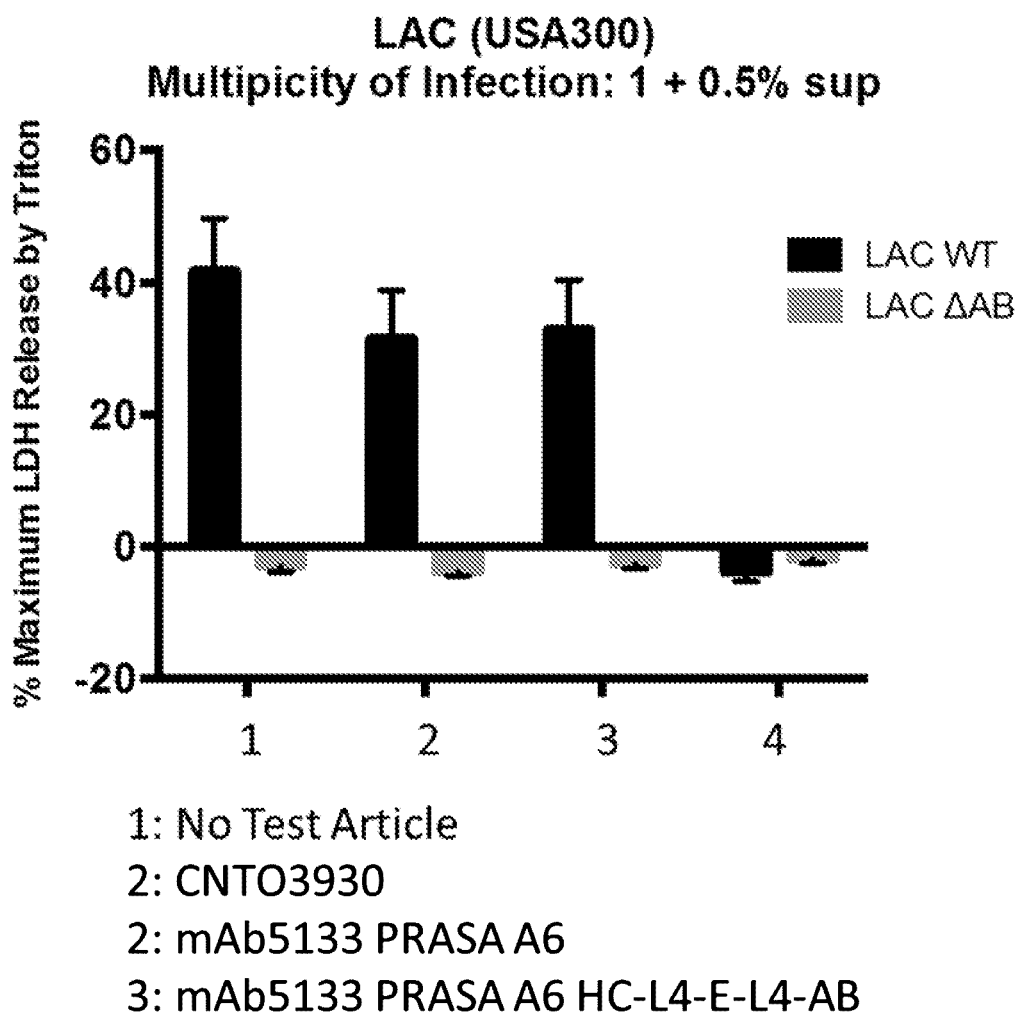
FIG. 13 is a graph showing that the mAb5133-FN3 fusion protein affords protection against *S. aureus* mediated intracellular cytolysis of primary human neutrophils.

FIG. 13 shows the relative activity of the test articles in protecting primary human neutrophils from cytolysis mediated by S. aureus LAC and LACΔLukAB strains as determined by release of LDH. As expected, CNTO3930 (Lane 2) afforded the least protection from S. aureus LAC mediated killing compared to the buffer-alone control (Lane 1) as it bears a V-region specific for the RSV-F protein and has no appended FN3 domain capable of binding and neutralizing the cytolytic leukotoxins. However, note that genetic inactivation of the LukAB leukotoxin eliminates PMN killing in this assay (Lanes 1 to 4). Similarly, mAB 5133 PRASA A6 (Lane 3) afforded little protection indicating that V-region surface engagement of the glycosylated forms of SDR proteins is not a protective mechanism in this intracellular killing assay. In contrast, mAb 5133 PRASA A6 HC-L4-E-L4-AB (Lane 4) afforded complete protection from S. aureus LAC mediated killing with an overall reduction equivalent to that seen with the S. aureus LACΔLukAB strain.

Summary.

These data indicate that mAb 5133-FN3 fusion proteins that bind and neutralize the cytolytic activity of leukotoxins LukAB are capable of protecting human primary neutrophils from leukotoxin-mediated killing following engulfment into the intracellular environment. This activity of mAb 5133-FN3 fusion protein targeting LukAB may be of therapeutic utility in the context of S. aureus mediated human infections.

Example 14: mAb5133-FN3 Fusion Proteins Improve Opsonophagocytotic Killing of *Staphylococcus aureus* by Primary Human Neutrophils Key classes of human immune cells including neutrophils kill S. aureus through opsonophagocytosis, a process where bacteria are engulfed into phagolysosome bodies and killed through the action of lytic and digestive enzymes. In counteracting this, S. aureus senses the acidic pH and the content of the phagolysosome environment, up-regulates the expression of key virulence determinants including leukotoxin AB, and kills the phagocyte from within following LukAB-mediated escape from the phagolysosome (Alonzo and Torres, "The Bicomponent Pore-forming Leucocidins of *Staphylococcus aureus*," Microbiol Mol Biol Rev. 78(2): 199-230 (2014), which is hereby incorporated by reference in its entirety). The studies described herein exemplify the ability of mAb5133-FN3 fusion proteins that bind and neutralize leukotoxins LukED and LukAB to enhance opsonophagocytotic killing by primary human neutrophils. As a negative control, RSV PRASA A6 HC-L4-wtTENCON fusion protein (Construct 27 in Table 1; SEQ ID NO: 977 HC plus SEQ ID NO: 843 LC) was used. This construct targets the respiratory syncytial virus F (RSV-F) protein via its V-region and bears a parental (wild-type consensus) FN3 domain that exhibits no leukotoxin binding or neutralization activities.

Procedure.

These studies employed a variety of MRSA of the USA300 lineage (LAC, FPR, 18807, 18808 and 18809), a USA500 lineage strain (BK2395), and a MSSA strain (BK4645b). S. aureus strains were grown overnight in RPMI+CAS medium and then sub-cultured 1:100 in RPMI+CAS and grown for a further 5 hours. The cultures were thereafter normalized to $1 \times 10^9$ CFU/mL with RPMI+CAS. Leukotoxin containing supernatants were prepared as filtrates of culture supernatants from cultures of S. aureus μgrown for 5 hours at 37° C. in RPMI+CAS following a 1:100 dilution of an overnight culture. To effect opsonization, pre-determined aliquots of bacteria necessary to achieve the desired MOI were combined with test articles plus or minus the addition of culture supernatant (11 μL) and RPMI-HEPES added to bring the volume to 440 μL (with each test article at a final concentration of 1.25 mg/mL). 96-well plates were coated with 20% human serum at 37° C. in 5% $CO_2$ and then washed twice with RPMI plus 10 mM HEPES and 0.1% HSA (RPMI-HH). A fresh preparation of purified human primary polymorphonuclear leukocytes (PMNs), re-suspended in RPMI plus 10 mM HEPES and 0.1% HSA (RPMI-HH) was added to each test well corresponding to ~250,000 per well. The plate was incubated at room temperature (RT) for 30 mins. 20 μL of the opsonized S. aureus mixture was added per well and synchronization effected by centrifuging the plates for 1,500 RPM for 7 minutes. Plates were incubated for 120 minutes at 37° C. in 5% $CO_2$. Following incubation, 11 μL of 1% saponin was added to each well and the plate incubated on ice for 20 mins. Thereafter, an aliquot from each well was serially diluted in phosphate buffered saline and aliquots plated on TSA plates to determine the remaining viable S. aureus cells through determination of colony forming units (CFUs). These experiments were performed with purified human primary polymorphonuclear leukocytes (PMNs) from six independent donors. Test articles evaluated were RSV PRASA A6 HC-L4-wtTENCON (Construct 27 in Table 1; SEQ ID NO: 977 HC plus SEQ ID NO: 843 LC), mAb 5133 PRASA A6 (Construct 4 in Table 1; SEQ ID NO: 66 HC plus SEQ ID NO: 67 LC), mAb 5133 PRASA A6 HC-L4-E (Construct 15 in Table 1; SEQ ID NO: 848 HC plus SEQ ID NO: 71 LC), mAb 5133 PRASA A6 HC-L4-E-L4-AB (Construct 28 in Table 1; SEQ ID NO: 858 HC plus SEQ ID NO: 67 LC) and mAb 5133 PRASA A6 HC-L4-E-L4-AB (Construct 11 in Table 1; SEQ ID NO: 856 HC plus SEQ ID NO: 67 LC).

Results.

Figure 14A:
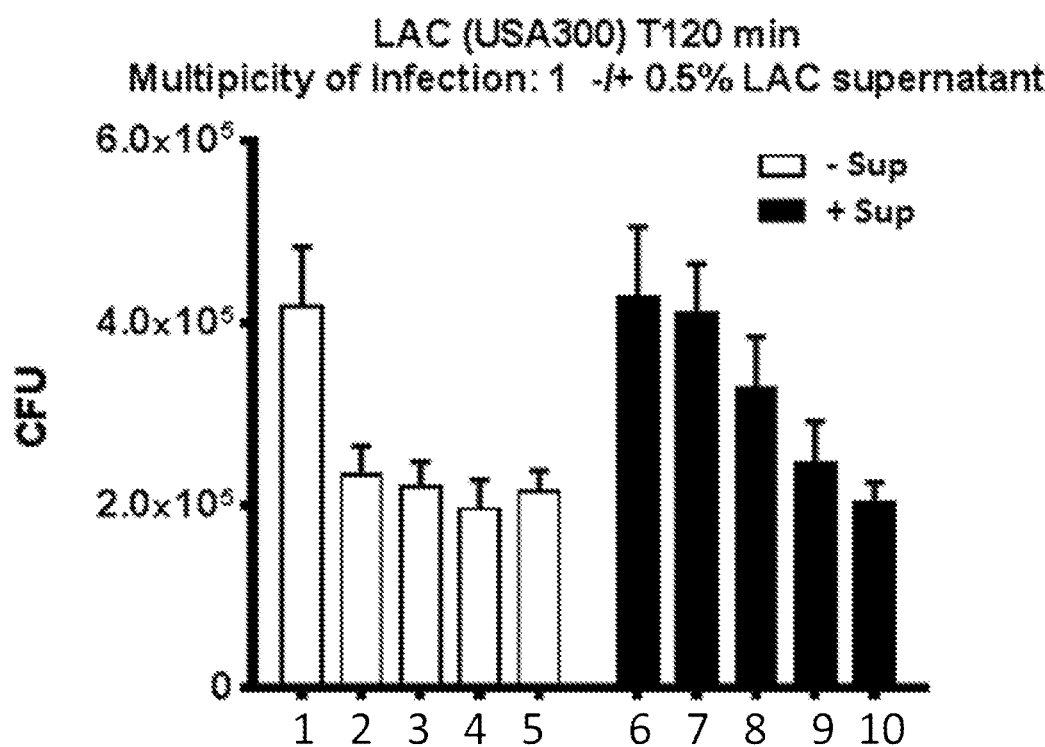
FIGS. 14A-14D show that mAb5133-FN3 fusion proteins enhance opsonophagocytotic death of various *S. aureus* strains including, USA300 LAC (FIG. 14A), USA300 FRP, 18807, 18808, and 18809 (FIG. 14B), BK4645b (MSSA) (FIG. 14C), and USA500 BK2395 (FIG. 14D) in primary human neutrophils.
Figure 14B:
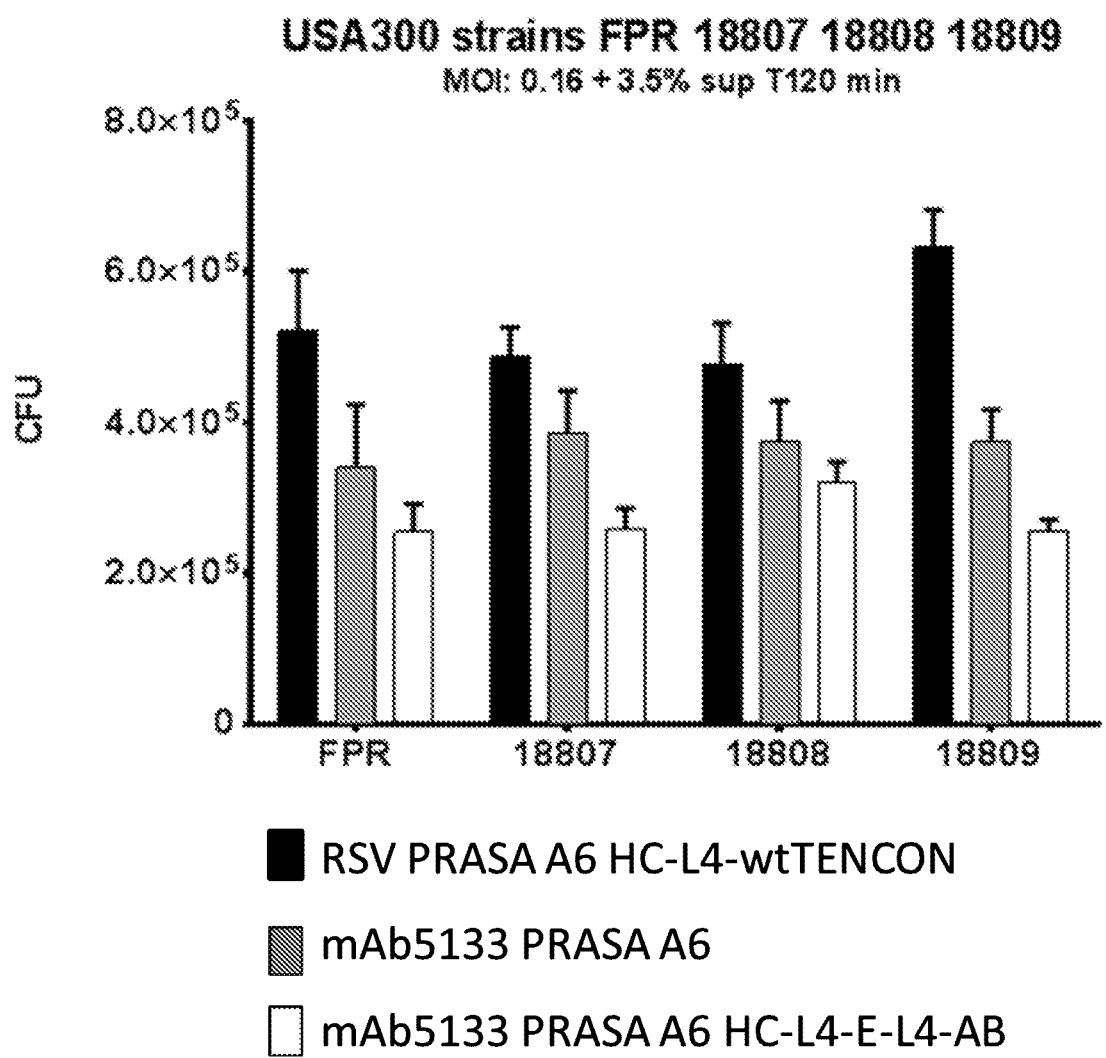
Figure 14C:
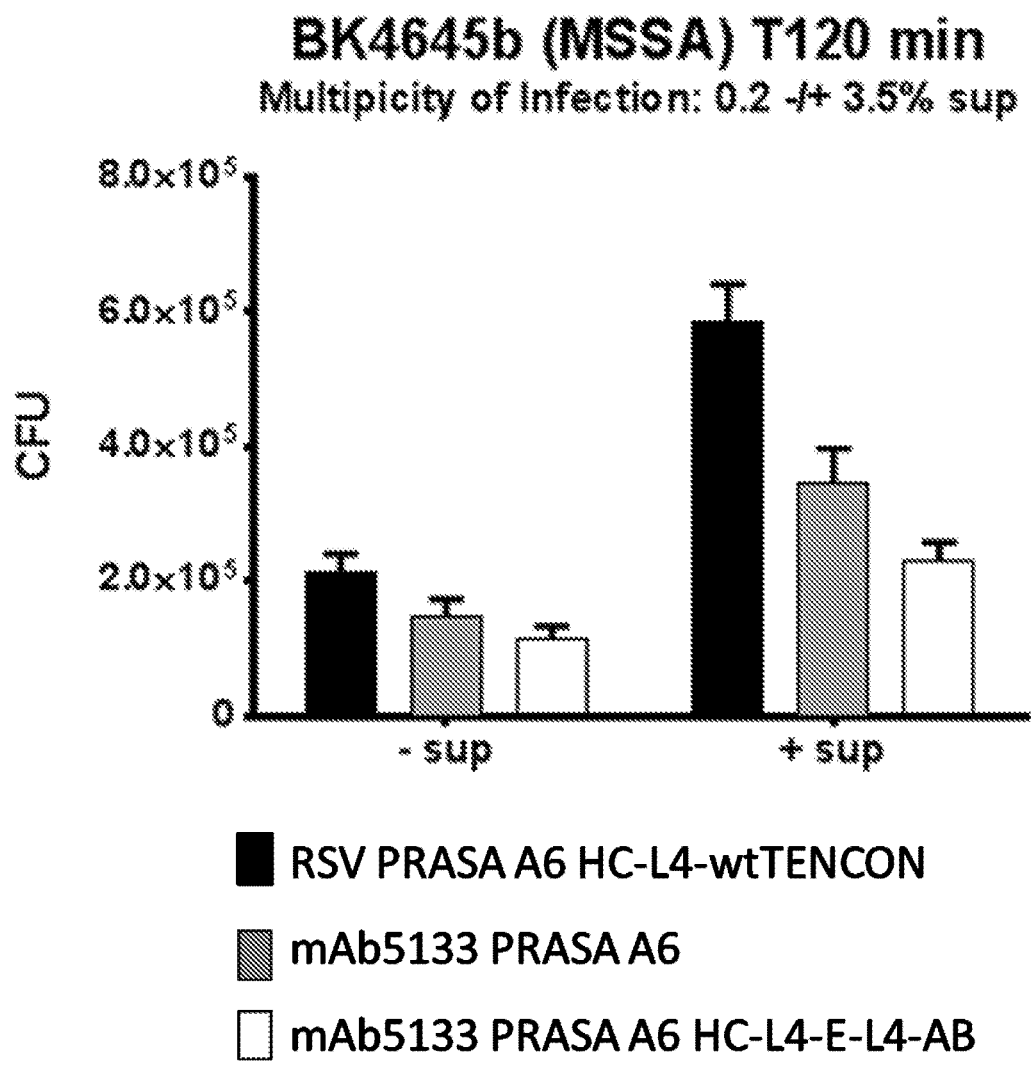
Figure 14D:
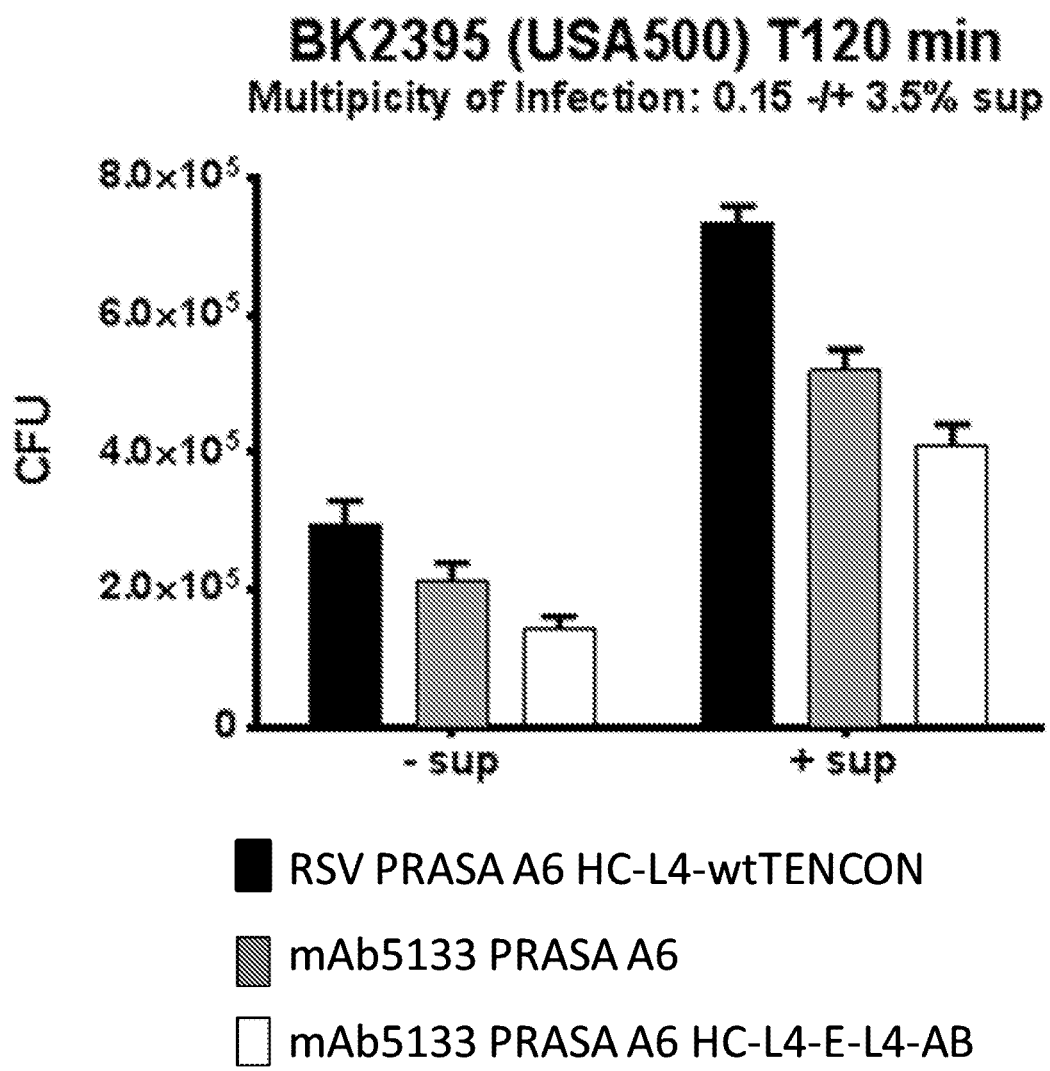

FIGS. 14A-14D shows the relative activity of the different test articles in enhancing opsonophagocytotic killing of a number of different S. aureus strains by primary human neutrophils. In FIG. 14A, data is shown for an opsonophagocytic killing (OPK) assay undertaken with the MRSA LAC strain at a MOI of 1+/−0.5% LAC culture supernatant (as an exogenous source secreted leukotoxins). As expected, RSV PRASA A6 HC-L4-wtTENCON (Lanes 1 and 6 in FIG. 14A) afforded the least protection from opsonophagocytotic killing of the CA-MRSA LAC strain as it bears a V-region specific for the RSV-F protein and has no appended FN3 domain capable of binding and neutralizing the cytolytic leukotoxins. In contrast, mAB 5133 PRASA A6 (Lane 2 in FIG. 14A) afforded marked OPK enhancement in the absence of adding culture supernatant indicating that V-region surface engagement of the glycosylated forms of SDR proteins is protective. However, this protection is eliminated when the assay is performed in the presence of culture supernatant (Lane 7 in FIG. 14A). In contrast, a series of mAb5133-FN3 fusion proteins that bind and neutralize the cytolytic activity of LukAB and/or LukED exhibited enhanced opsonophagocytotic killing in the presence or absence of culture supernatant (Lanes 3-5 and 8-10 in FIG. 14A) with the best overall protection observed with mAb5133-FN3 fusion proteins that bind and neutralize the cytolytic activity of both LukAB and LukED. Similar observations are seen in OPK assays employing a variety of S. aureus strains including additional USA300 lineage MRSA strains FPR, 18807, 18808 and 18809 (FIG. 14B), a MSSA strain BK4645b (FIG. 14C) an a USA500 lineage MRSA strain BK2395 (FIG. 14D).

Summary.

These data indicate that mAb 5133-FN3 fusion proteins that bind and neutralize the cytolytic activity of both leukotoxins LukED and LukAB afford the best enhancement of opsonophagocytotic killing mediated by human neutrophils. This activity of mAb 5133-FN3 fusion protein targeting both leukotoxins LukED and LukAB may be of therapeutic utility in the context of S. aureus mediated human infections.

Example 15: Identification and Characterization of Monoclonal Antibodies Targeting S. aureus Protein-A S. aureus protein A (SpA) is a key immune evasion factor which is either expressed and assembled on the cell surface or is secreted by the bacteria. Protein A binds the Fc (Fragment, crystallizable) domain of immunoglobulins as well as the fragment antigen-binding (Fab) domains of VH3 class IgGs and IgM (Forsgren A., "Protein A from *Staphylococcus aureus* VI. Reaction with Subunits from Guinea Pig γ1- and γ2-globulin", *J. Immunol.* 100: 927-30 (1968); Silverman G. J. and Goodyear, C. S., "Confounding B-cell Defences: Lessons from a Staphylococcal Superantigen", *Nat. Rev. Immunol.* 6: 465-75 (2006), which are hereby incorporated by reference in their entirety). This Fc binding activity of Protein A enables S. aureus to escape opsonophagocytic killing, whereas crosslinking of VH3-type IgM B cell receptors disrupts the development of adaptive immune responses (Falugi F., et al. "The Role of Protein A in the Evasion of Host Adaptive Immune Responses by *Staphylococcus aureus*", *mBio* 4: e00575-613 (2013), which is hereby incorporated by reference in its entirety). In exploring the relative contribution(s) of Fc-mediated binding by Protein A in limiting opsonophagocytic killing mediated by antibodies that target other cell surface localized S. aureus antigens, a series of monoclonal antibodies were identified that bind Protein A specifically via their Fab domains and these were subsequently engineered to remove Protein A binding mediated by Fc interactions.

Procedure.

Fab domains with high affinity for recombinant Protein A (ProSpec-TanyTechnoGene Ltd.) were identified via phage display and converted to human IgG1 mAbs. In the screening process, VH3 class Fabs were de-selected by selective restriction digestion. Three Protein A specific mAbs were selected for further characterization: ProA3 (SEQ ID NO: 1001 HC plus SEQ ID NO: 841 LC), SM1F5 (SEQ ID NO: 1007 HC plus SEQ ID NO: 1016 LC) and SM1F9 (SEQ ID NO: 1012 HC plus SEQ ID NO: 842 LC) and these were subsequently engineered to exhibit GluV8 protease resistance via introduction of the PRASA hinge region mutations (see Table 1) and/or Protein A binding via their Fc region via introduction of the A6 mutations (see Table 1). Characterization of Protein A binding was determined by ELISA. Briefly, plates were coated with streptavidin (5 μg/mL in PBS, 50 μL per well) and incubated overnight at 4° C. Plates were washed three times with ELISA wash buffer (0.15M NaCl, 0.02% Tween-20) and then coated with biotinylated Protein A at 2 μg/mL (50 L per well) in PBS for one hour at room temperature. Plates were then washed three times with ELISA wash buffer and then blocked with ELISA blocking buffer (3% BSA in PBS, 200 μL per well). Test articles were then added in a 3-fold dilution series starting at 10 μg/mL and the plates incubated at room temperature for one hour. Plates were then washed three times with ELISA wash buffer and 50 mL per well of HRP-conjugated goat anti-human kappa light chain (Millipore AP502P) added at a 1:15,000 dilution in 3% BSA in PBS and the plates incubated for one hour at room temperature. Plates were then washed five times with ELISA wash buffer and bound HRP detected using the 3,3',5,5'-Tetramethylbenzidine (TMB; Fitzgerald) as a chromogenic substrate. Test Articles used were ProA3 PRASA A6 (Construct 29 in Table 1), ProA3 IgG1 (Construct 30 in Table 1), ProA3 PRASA (Construct 31 in Table 1), anti-LTA (Pagibaximab) IgG1 (Construct 32 in Table 1) and anti-LTA (Pagibaximab) PRASA A6 (Construct 33 in Table 1).

Results.

Figure 15:
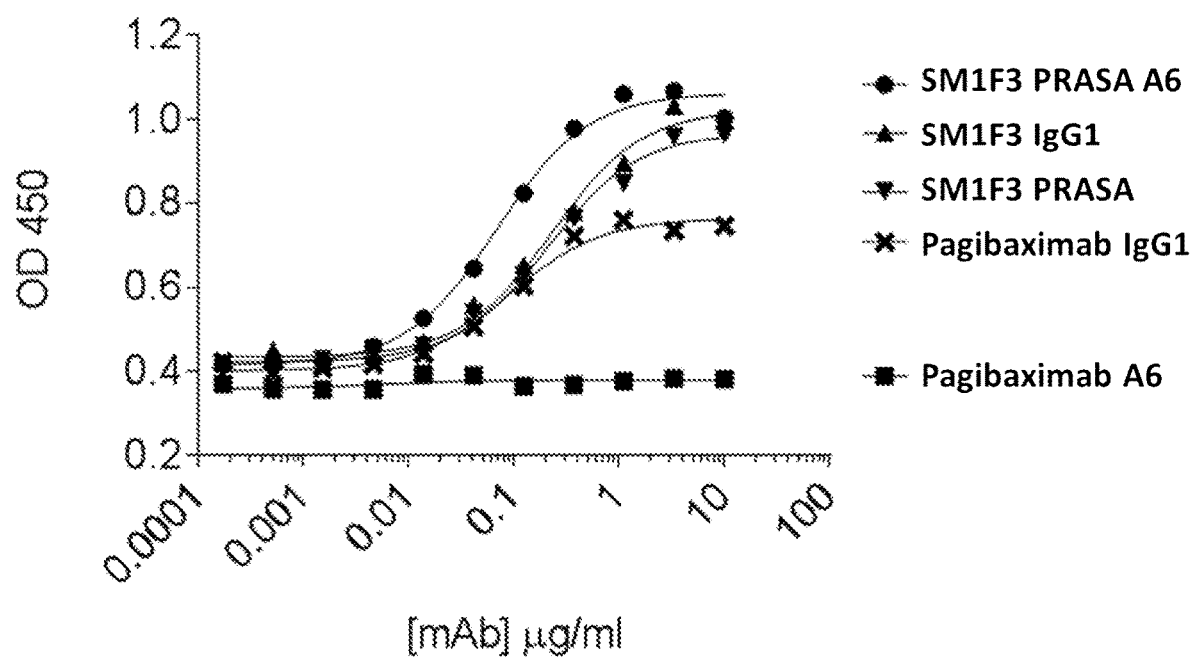
FIG. 15 shows the binding of a series of monoclonal antibodies to *S. aureus* protein A to exemplify binding via the Fc (Fragment, crystallizable) and/or Fab (fragment, antigen-binding) regions.

The binding of a monoclonal antibody to Protein A solely via Fc interaction is exemplified in FIG. 15 by comparison of the ELISA binding curves for IgG1 wild-type pagibaximab and an engineered PRASA A6 variant that both target lipoteichoic acid via their Fab domains. As expected, no detectable binding to Protein A is observed in the case of the PRASA A6 variant. By way of example, the enhanced binding of monoclonal antibodies that target Protein A via their Fab domains is exemplified in FIG. 15 in studies of a series of ProA3 related test articles. For these molecules, equivalent binding is observed for the IgG1 and PRASA variants with apparent tighter binding to plate-immobilized Protein A observed for the PRASA A6 variant.

Summary.

While the reasons underlying the apparent higher binding affinity for plate-immobilized Protein A exhibited by the PRASA A6 variant of the anti-Protein A antibody ProA3 are unclear, these data exemplify the identification of IgG antibodies capable of binding S. aureus protein A via the Fab region that is distinct from normal Fc-mediated interactions.

Example 16: mAb5133-FN3 Fusion Proteins Provide Improved Protection from LukAB-Dependent Extracellular Killing of Primary Human Neutrophils Leukotoxins are capable of killing key classes of human immune cells, including neutrophils both from the outside of the cell via a process triggered by engagement with specific receptors on the immune cell surface and are also capable of killing from the inside of the cell through leukotoxin-mediated escape from the phagolysosome (Alonzo and Torres, "The bicomponent pore-forming leucocidins of *Staphylococcus aureus*," *Microbiol. Mol. Biol. Rev.* 78(2): 199-230 (2014), which is hereby incorporated by reference in its entirety). The studies described herein exemplify the ability of mAb5133-FN3 fusion proteins that bind and neutralize leukotoxins LukED and LukAB to afford protection of primary human neutrophils from extracellular killing mediated by a number of S. aureus strains and the dependence of this phenomenon on the expression of LukAB. These studies employed otherwise-isogenic pairs of strains that either produce LukAB or fail to do so due to an engineered deletion of the lukAB operon; specifically (i) S. aureus strain Newman (Baba et al., "Genome Sequence of *Staphylococcus aureus* Strain Newman and Comparative Analysis of Staphylococcal Genomes: Polymorphism and Evolution of Two Major Pathogenicity Islands," *J. Bacteriol.* 190(1):300-310 (2008), which is hereby incorporated by reference in its entirety) labeled 'Newman-WT' and a lukAB deletion derivative thereof ('Newman-ΔAB'), (ii) *S. aureus* USA 300 MRSA strain LAC (Chambers, H. F., "Community-associated MRSA-resistance and virulence converge," *N. Engl. J. Med.* 352:1485-1487 (2005), which is hereby incorporated by reference in its entirety) labeled 'LAC-WT' and a lukAB deletion derivative thereof ('LAC-ΔAB'), (iii) *S. aureus* USA 300 MRSA strain BK18807, a 2005 isolate from a bacteremia patient (Kennedy et al., "Epidemic community-associated methicillin-resistant *Staphylococcus aureus*: recent clonal expansion and diversification," *Proc. Natl. Acad. Sci. U.S.A* 105:1327-1332 (2008), which is hereby incorporated by reference in its entirety) labeled '18807-WT' and a lukAB deletion derivative thereof ('18807-ΔAB'), (iv) *S. aureus* USA 300 MRSA strain BK18808, a 2005 isolate from a patient with endocarditis (Kennedy et al., "Epidemic community-associated methicillin-resistant *Staphylococcus aureus*: recent clonal expansion and diversification," *Proc. Natl. Acad. Sci. U.S.A* 105:1327-1332 (2008), which is hereby incorporated by reference in its entirety) labeled '18808-WT' and a lukAB deletion derivative thereof ('18808-ΔAB'), and (v) *S. aureus* USA 300 MRSA strain BK18809, a 2005 isolate from a bacteremia patient (Kennedy et al., "Epidemic community-associated methicillin-resistant *Staphylococcus aureus*: recent clonal expansion and diversification," *Proc. Natl. Acad. Sci. U.S.A* 105:1327-1332 (2008), which is hereby incorporated by reference in its entirety) labeled '18809-WT' and a lukAB deletion derivative thereof ('18809-ΔAB').

Procedure.

*S. aureus* strains were grown overnight in RPMI+CAS medium and then sub-cultured 1:100 in RPMI+CAS and grown for a further 5 hours. The culture was thereafter normalized to $1 \times 10^9$ CFU/mL with PBS. 96-well plates were coated with 20% human serum for 20 mins at 37° C.+5% $CO_2$ and then washed twice with RPMI plus 10 mM HEPES (RPMI-H). 75 µl of a freshly prepared preparation of purified human primary polymorphonuclear leukocytes (PMNs) was then added to each test well corresponding to ~200,000 cells per well and the plate incubated at room temperature (RT) for 30 mins. 10 µL of Test Articles (at 1.25 mg/mL) were added to appropriate wells to achieve a final concentration of 125 µg/mL. 20 µL of pre-diluted bacteria were then added per well to yield a multiplicity of infection (MOI) of ~25. Following a two hour incubation at 37° C. in 5% $CO_2$, the plates were centrifuged for 5 mins at 1,500 RPM at 4° C. and assessment of cytolysis determined by lactate dehydrogenase (LDH) release. For this, 25 µL of the supernatants from each test well were transferred into a new black, clear bottom 96-well plate and 25 µL of CytoTox-ONE™ Assay reagent (Promega) was added and the plate incubated in the dark for 15 mins. CytoTox-ONE™ Assay reagent measures the release of LDH from cells with a damaged membrane via a coupled enzymatic assay that results in the conversion of resazurin into a fluorescent resorufin product detected via plate reading in a spectrometer. Test articles evaluated were CNTO3930 (Construct 21 in Table 1; SEQ ID NO: 104 HC plus SEQ ID NO: 105 LC), mAb 5133 PRASA A6 (Construct 4 in Table 1; SEQ ID NO: 66 HC plus SEQ ID NO: 67 LC), mAb 5133 PRASA A6 HC-L4-E-L4-AB (Construct 11 in Table 1; SEQ ID NO: 856 HC plus SEQ ID NO: 67 LC) and mAb 5133 PRASA A6 HC-L4-E-L1-AB (Construct 12 in Table 1; SEQ ID NO: 952 HC plus SEQ ID NO: 67 LC).

Results.

Figure 16:
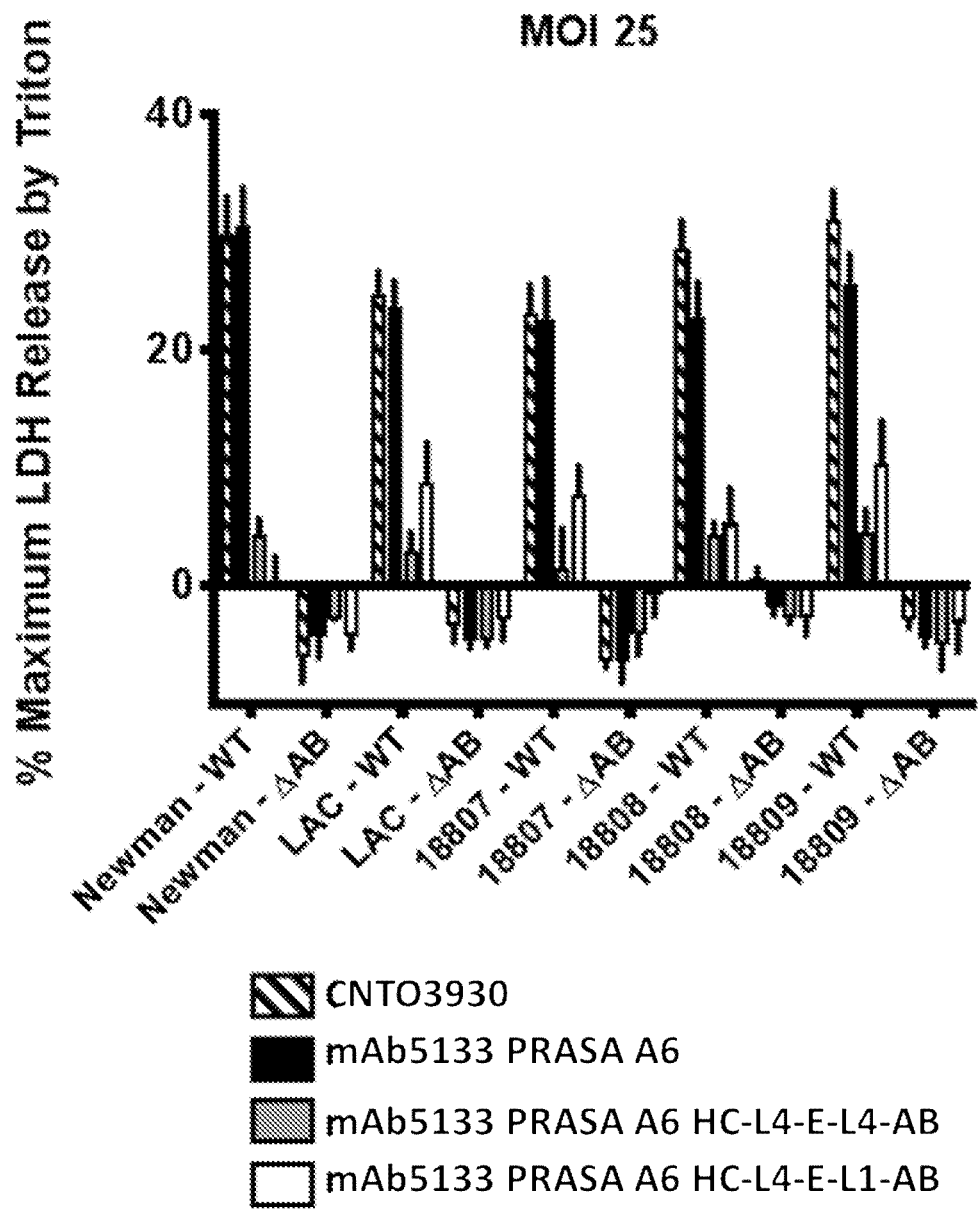
FIG. 16 is a graph showing that mAb5133-FN3 fusion proteins afford improved protection from LukAB-dependent extracellular killing of primary human neutrophils.

FIG. 16 shows the relative activity of the test articles in protecting primary human neutrophils from cytolysis following incubation with a series of pairs of otherwise-isogenic strains that differ only in the expression of the LukAB leukotoxin—as determined by release of LDH.

In these studies, CNTO3930 and mAb 5133 PRASA A6 afforded the least protection of primary human neutrophils from killing mediated by all LukAB producing strains as indicated by the maximal LDH release observed. That this killing is dependent on LukAB production is supported by the observation that no LDH release is observed in the presence of either CNTO3930 or mAb 5133 PRASA A6 when strains lacking LukAB expression are employed. In contrast, both mAb5133-FN3 fusion proteins studied that bind and neutralize LukAB, i.e., mAb 5133 PRASA A6 HC-L4-E-L4-AB and mAb 5133 PRASA A6 HC-L4-E-L1-AB, afforded protection of primary human neutrophils from killing mediated by all LukAB producing strains as indicated by reduced LDH release with mAb 5133 PRASA A6 HC-L4-E-L4-AB typically affording somewhat enhanced protection over mAb 5133 PRASA A6 HC-L4-E-L1-AB. As expected, killing in the presence of mAb 5133 PRASA A6 HC-L4-E-L4-AB and mAb 5133 PRASA A6 HC-L4-E-L1-AB was observed to be dependent on the production of LukAB.

Summary.

These data indicate that mAb 5133-FN3 fusion proteins that bind and neutralize the cytolytic activity of leukotoxins LukAB are capable of protecting human primary neutrophils from leukotoxin-mediated killing. This activity of mAb 5133-FN3 fusion proteins targeting LukAB may be of therapeutic utility in the context of *S. aureus* mediated human infections.

Example 17: mAb5133-FN3 Fusion Proteins Protect Primary Human Neutrophils from Extracellular Killing by Non-Cognate Leukotoxin Pairs LukE/LukF-PV and LukE/HlgB Based on the genetic arrangements of genes encoding leukocidins and the co-regulation of loci encoding S and F subunits and the purification and characterization of native proteins, five cognate leukocidins have been identified in *S. aureus*: LukAB, LukS-PV/LukF-PV, LukED, HlgAB and HlgCB (Alonzo and Torres, "The bicomponent pore-forming leucocidins of *Staphylococcus aureus*," *Microbiol. Mol. Biol. Rev.* 78(2): 199-230 (2014), which is hereby incorporated by reference in its entirety). However, with the exception of LukAB that is produced as a native heterodimer, a number of studies have reported that active leukocidins can be prepared through combination of non-cognate pairs of recombinant S and F subunits (Gravet et al., "Characterization of a novel structural member, LukE-LukD, of the bi-component staphylococcal leukotoxins family," *FEBS Letters* 436: 202-208 (1998); Morinaga et al., "Purification, Cloning and Characterization of Variant LukE-LukD with Strong Leukocidal Activity of Staphylococcal Bi-Component Leukotoxin Family," *Microbiol. Immunol.* 47(1): 81-90 (2003); Rouha et al., "Five birds, one stone: Neutralization of alpha-hemolysin and four bi-component leukocidins of *Staphylococcus aureus* with a single monoclonal antibody," *MAbs.* 7(1): 243-54 (2015), which are hereby incorporated by reference in their entirety) and include the non-cognate pairs LukE/LukF-PV and LukE/HlgB. The studies described herein exemplify the ability of mAb5133-FN3 fusion proteins that bind and neutralize leukotoxins LukED (and LukAB) to afford protection of primary human neutrophils from extracellular killing mediated by LukE/LukF-PV and LukE/HlgB.

Procedure.

Recombinant variants of LukE, LukF-PV and HlgB subunits were individually prepared from *S. aureus*. To demonstrate the leukocidal activity of the non-cognate leukocidins LukE/LukF-PV and LukE/HlgB, individual subunits were combined on an equal weight basis with 200,000 freshly purified human primary polymorphonuclear leukocytes (PMNs) in RPMI+10 mM HEPES in a total volume of 100 µL and incubated for one hour at 37° C. in a $CO_2$ incubator. 25 µl of supernatant was then carefully transferred to a new plate after spinning the plate down at 1500 RPM for 10 mins and cell lysis determined using the Cell Titer reagent (Promega) based on quantitation of the ATP present, an indicator of metabolically active cells. To determine the relative activity of mAb5133-FN3 fusion proteins in neutralizing the cytolytic activity of LukE/LukF-PV and LukE/HlgB leukotoxins against human PBMCs, 2.5 µg of LukE and 2.5 µg of HlgB, or 5 µg of LukE plus 5 µg of HlgLukF-PV, were combined with increasing concentrations of each test article and incubated on ice for 20 minutes. Freshly isolated primary human neutrophils (hPMNs, 200,000 cells in 70 µl of RPMI+10 mM HEPES+0.1% HSA) were then added and the mixtures incubated for 1-hour at 37° C. in a 5% $CO_2$ incubator. The reaction plates were then centrifuged for 5 mins at 1,500 RPM at 4° C. and assessment of cytolysis determined by lactate dehydrogenase (LDH) release. For this, 25 µL of the supernatants from each test well were transferred into a new black, clear bottom 96-well plate, 25 µL of CytoTox-ONE™ Assay reagent (Promega) was added, and the plate incubated in the dark for 15 mins. CytoTox-ONE™ Assay reagent measures the release of LDH from cells with a damaged membrane via a coupled enzymatic assay that results in the conversion of resazurin into a fluorescent resorufin product detected via plate reading in a spectrometer. Test articles evaluated were CNTO3930 (Construct 21 in Table 1; SEQ ID NO: 104 HC plus SEQ ID NO: 105 LC), mAb 5133 PRASA A6 HC-L4-E-L4-AB (Construct 11 in Table 1; SEQ ID NO: 856 HC plus SEQ ID NO: 67 LC) and mAb 5133 PRASA A6 HC-L4-E-L1-AB (Construct 12 in Table 1; SEQ ID NO: 952 HC plus SEQ ID NO: 67 LC). As additional controls, purified LukED toxin (at a final concentration of 2.5 µg/mL) was added to reactions containing either CNTO3930 or mAb 5133 PRASA A6 HC-L4-E-L1-AB.

Figure 17A:
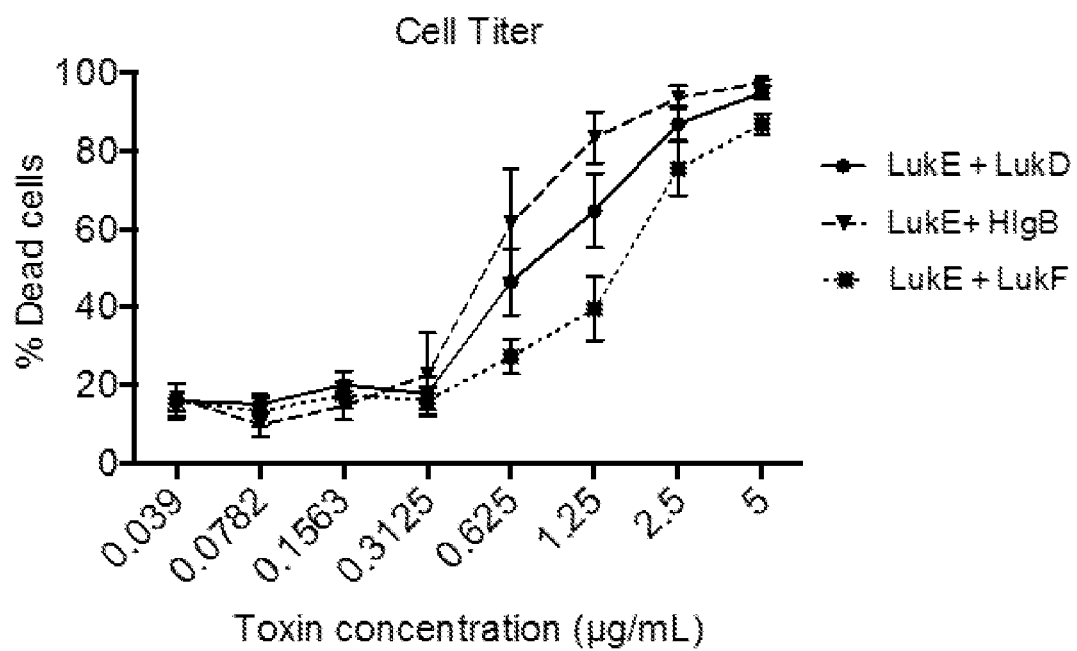
FIGS. 17A-17C show that mAb5133-FN3 fusion proteins afford improved protection from extracellular killing of primary human neutrophils by non-cognate leukotoxin pairs LukE/LukF-PV and LukE/HlgB.
Figure 17B:
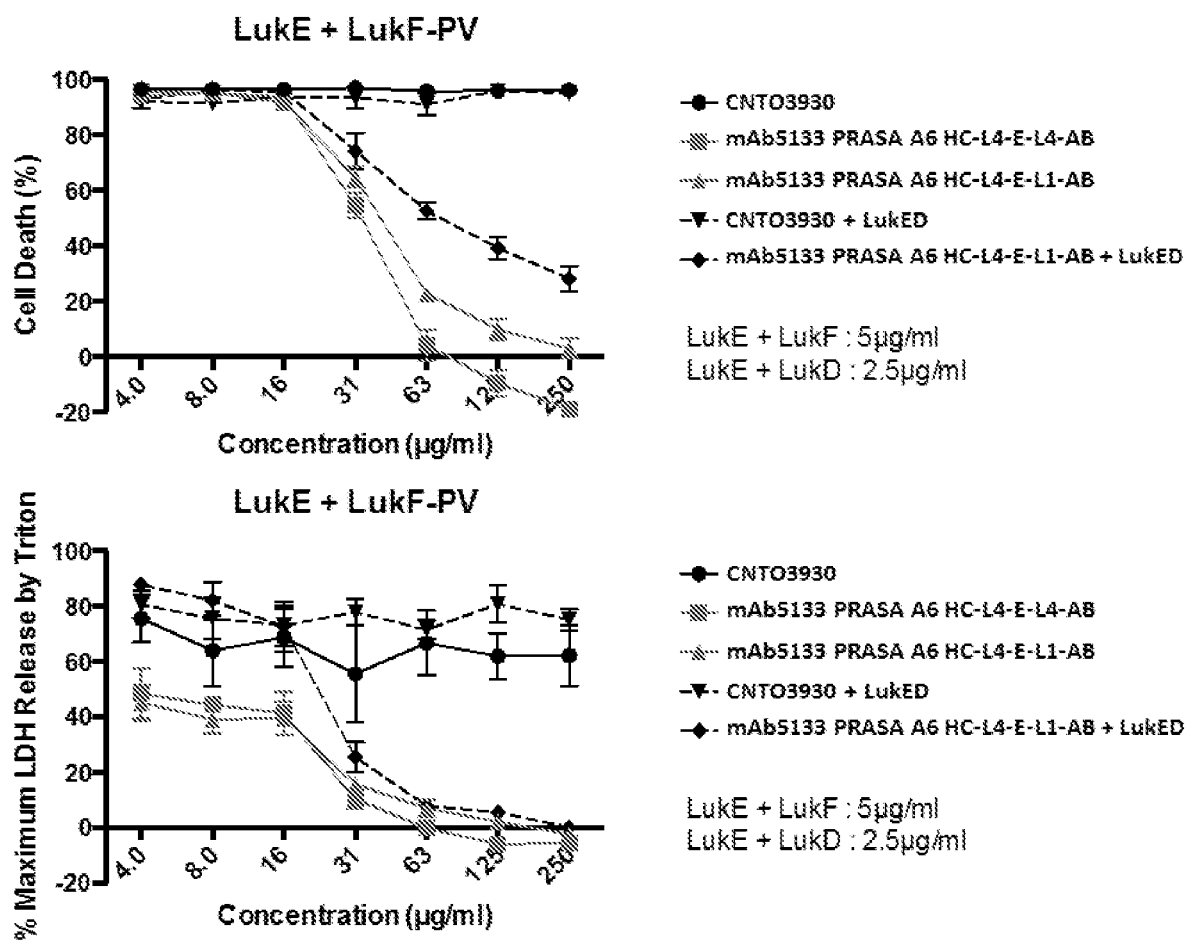
Figure 17C:
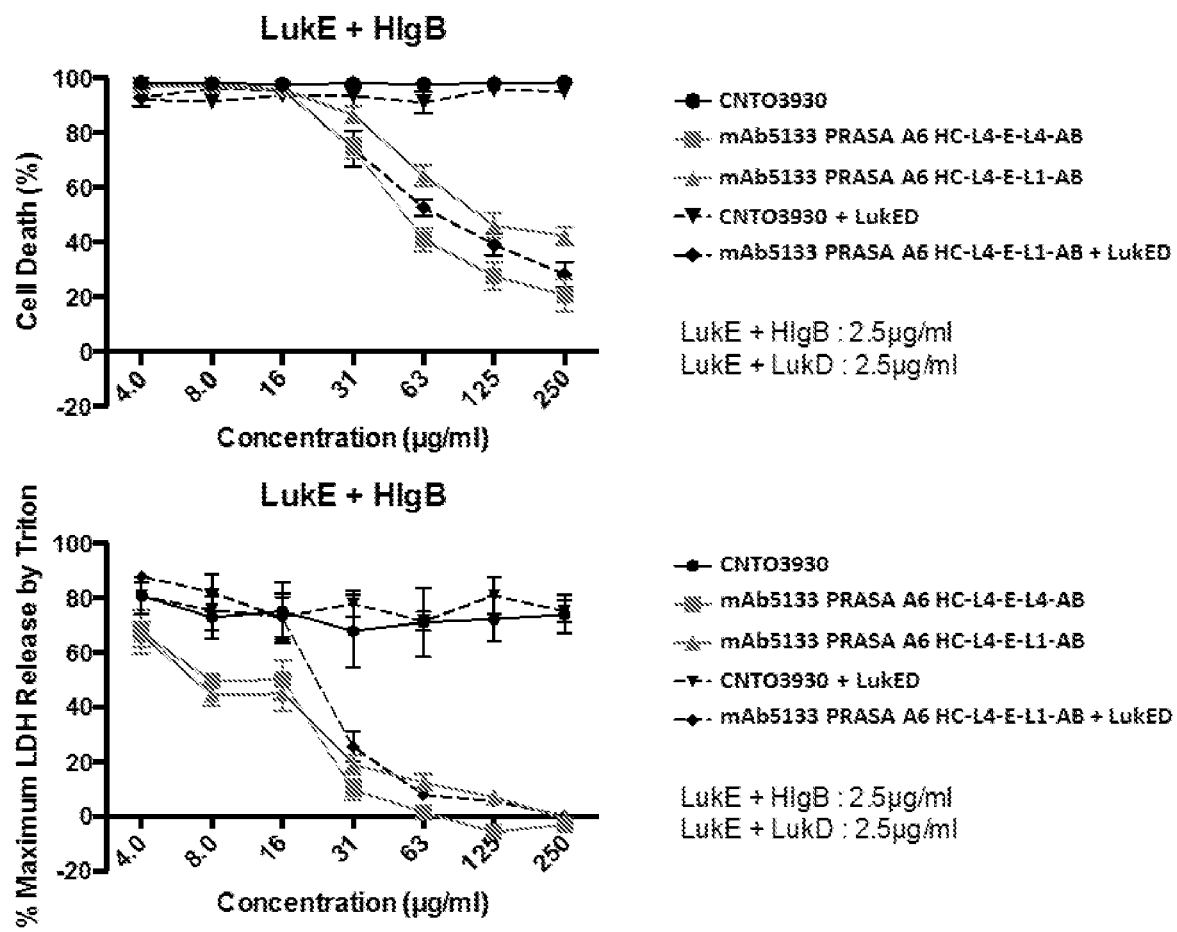

Results. FIG. 17A shows the relative cytolytic activity of the cognate LukED and non-cognate LukE/LukF-PV and LukE/HlgB leukotoxins for primary human neutrophils with concentration-dependent lysis observed for all test articles with the apparent potency under these conditions LukE/HlgB>LukED>LukE/LukF-PV. FIG. 17B shows the relative activity of CNTO3930 and two mAb5133-FN3 fusion proteins in protecting primary human neutrophils from LukE/LukF-PV mediated cytolysis, as determined by the release of LDH. As expected, the anti-RSV CNTO3930 antibody affords no apparent protection from LukE/LukF-PV cytolysis and overall cell killing was not impacted by addition of LukED. In contrast, both mAb 5133 PRASA A6 HC-L4-E-L4-AB and mAb 5133 PRASA A6 HC-L4-E-L1-AB afforded concentration-dependent protection from LukE/LukF-PV mediated cytolysis with the addition of LukED to mAb 5133 PRASA A6 HC-L4-E-L1-AB exhibiting somewhat reduced overall neutralization activity. Similarly, as shown in FIG. 17C (top and bottom panels), the anti-RSV CNTO3930 antibody affords no apparent protection from LukE/HlgB mediated cytolysis, and overall cell killing was not impacted by addition of LukED. In contrast, both mAb 5133 PRASA A6 HC-L4-E-L4-AB and mAb 5133 PRASA A6 HC-L4-E-L1-AB afforded concentration-dependent protection from LukE/HlgB mediated cytolysis with the addition of LukED to mAb 5133 PRASA A6 HC-L4-E-L1-AB exhibiting somewhat reduced overall neutralization activity.

Summary.

These data indicate that mAb 5133-FN3 fusion proteins that bind LukE and neutralize the cytolytic activity of the LukED leukocidin are also capable of protecting human primary neutrophils from cytolytic killing mediated by two non-cognate leukocidins bearing the LukE subunit—namely, LukE/LukF-PV and LukE/HlgB. This broader leukocidin-neutralizing activity of mAb 5133-FN3 fusion proteins targeting LukE may be of therapeutic utility in the context of *S. aureus* mediated human infections.

Example 18: Neutralization of LukED Mediated Hemolysis of Human Red Blood Cells by mAb5133-FN3 Fusion Proteins A key feature of the pathogenesis of *S. aureus* in the bloodstream is the scavenging of iron through the production of toxins that lyse erythrocytes, releasing hemoglobin, the most abundant iron source in mammals. In recent studies the Duffy antigen receptor for chemokines (DARC) was identified as the receptor for the *S. aureus* hemolytic leukocidins LukED and HlgAB (Spaan et al., "*Staphylococcus aureus* Targets the Duffy Antigen Receptor for Chemokines (DARC) to Lyse Erythrocytes," *Cell Host & Microbe* 18(3): p. 363-370 (2015), which is hereby incorporated by reference in its entirety). Herein it is demonstrated that a mAb5133-FN3 fusion protein that exhibits LukED toxin neutralization activity as determined in assays employing freshly isolated hPMNs (see EXAMPLE 4), also protects human erythrocytes (red blood cells) from LukED-mediated hemolysis.

Procedure.

Figure 18A:
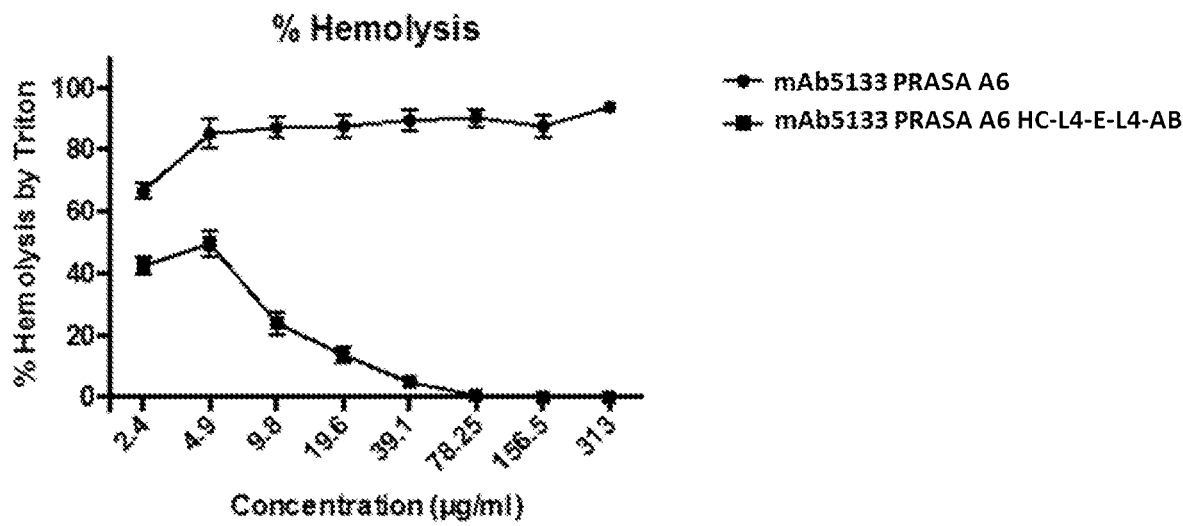
FIGS. 18A-18B demonstrate that mAb 5133-FN3 fusion proteins that bind LukE and neutralize the cytolytic activity that LukED exerts towards hPMNs, also neutralize the hemolytic activity of LukED on human erythrocytes.
Figure 18B:
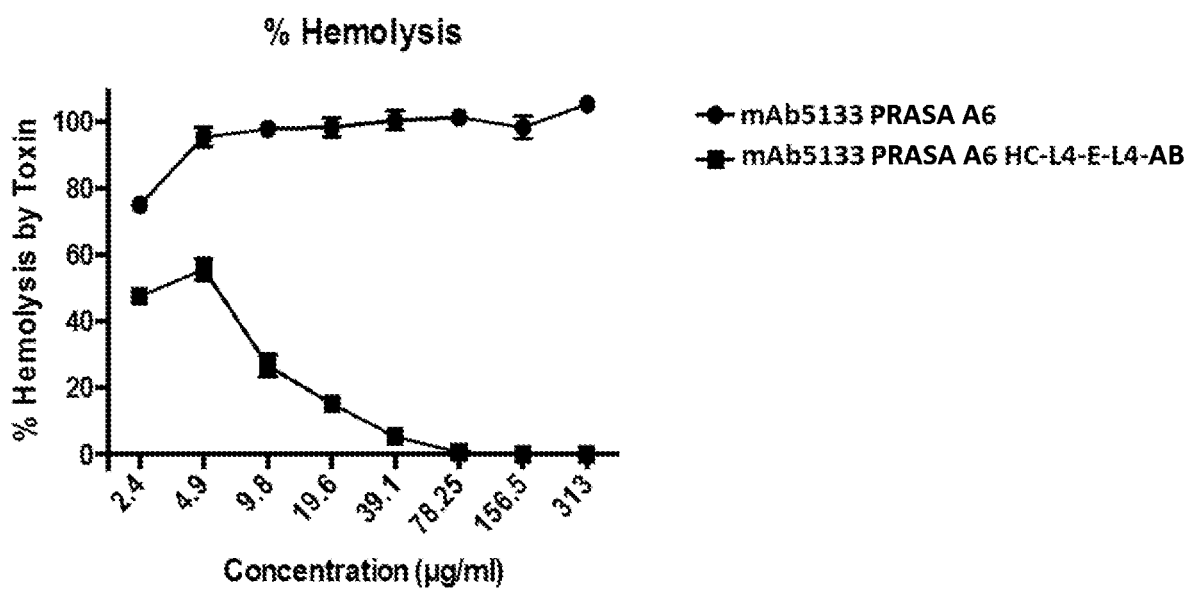

A constant concentration of 4.8 µg/mL per subunit of recombinant LukED (corresponding to the mouse $LD_{90}$ concentration) in a volume of 40 µL was incubated with increasing concentrations of either mAb 5133 PRASA A6 (Construct 4 in Table 1; SEQ IDs #66 HC plus 67 LC) or mAb 5133 PRASA A6 HC-L4-E-L4-AB (Construct 11 in Table 1; SEQ IDs #856 HC plus 67 LC) in a total volume of 80 µL for 30 mins on ice. Blood from fresh human leukopaks was washed three times in 0.9% saline and red blood cells (RBCs) at $8\times10^7$ cells in 0.9% saline in a volume of 80 µL were added to the toxin-test article mixture in a 96-well plate. Two control reactions were also run in parallel: (i) LukED and RBCs alone with no test articles, and (ii) RBCs alone with 0.2% Triton-X100 with no test articles or LukED. After 30 mins of intoxication/incubation at 37° C. in the presence of 5% $CO_2$, plates were spun down for 10 minutes at 1780 g at 4° C. 100 µL of the cell free lysates were then transferred to a new 96-well plate and the $OD_{405}$ nm was measured as a measure of hemolysis. The data shown in FIGS. 18A and 18B is compiled from the results of studies using three individual blood donors. The extent of hemolysis (expressed as a %) was determined using the following formulation:

$$\left(\left(\frac{OD_{405nm} - \text{Cells only average}}{\text{Triton or Toxin average} - \text{Cells only average}}\right)\right)$$

Results.

FIG. 18B shows the % hemolysis observed with LukED in the presence of mAb 5133 PRASA A6 or mAb 5133 PRASA A6 HC-L4-E-L4-AB as compared to the 100% value observed with LukED alone. As expected, only the mAb 5133 PRASA A6 HC-L4-E-L4-AB test article that bears a LukED neutralizing FN3 domain is observed to protect erythrocytes from LukED mediated hemolysis. FIG. 18A shows the % hemolysis observed with LukED in the presence of mAb 5133 PRASA A6 or mAb 5133 PRASA A6 HC-L4-E-L4-AB as compared to the 100% value observed with Triton-X100 alone. Similarly, only the mAb 5133 PRASA A6 HC-L4-E-L4-AB test article that bears a LukED neutralizing FN3 domain is observed to protect erythrocytes from LukED mediated hemolysis.

Summary.

These data indicate that mAb 5133-FN3 fusion proteins that bind LukE and neutralize the cytolytic activity of the LukED leucocidin versus hPMNs also neutralize the hemolytic activity of the LukED leucocidin versus human erythrocytes. LukED cytolysis of hPMNs is thought to be mediated following target cell engagement via the CXCR1/CXCR2 receptors whereas the hemolysis of erythrocytes is mediated following target cell engagement via the DARC receptor. Hence, these data support the notion that neutralization of the cytolytic activities of LukED mediated by mAb 5133-FN3 fusion proteins can be independent of the nature of target cell engagement as conferred by specific target cell receptors.

Example 19: Identification of Potential Neutralization Epitopes on Leukocidin LukAB by Solution Phase Hydrogen/Deuterium Exchange (HDX)-Mass Spectrometry (MS)

For higher order structural studies, hydrogen-deuterium exchange coupled with mass spectrometry analysis, referred to herein as HDX-MS, has proven a valid method in the identification of binding surfaces between interacting proteins (Hamuro et al., "Rapid Analysis of Protein Structure and Dynamics by Hydrogen/Deuterium Exchange Mass Spectrometry," *J. of Biomolecular Techniques* 14: 171-182 (2003) and Hom et al., "The Role of Protein Dynamics in Increasing Binding Affinity for an Engineered Protein-Protein Interaction Established by H/D Exchange Mass Spectrometry," *Biochemistry* 45: 8488-8498 (2006), which are hereby incorporated by reference in their entirety). Herein are described studies to identify the potential binding epitope(s) for the Luk17 FN3 protein (SEQ ID NO: 14) on the LukAB heterodimer by solution phase HDX-MS methods using a recombinant toxoid variant (LukA E323A) of LukAB protein produced from *Staphylococcus aureus* (SEQ ID NOs: 10 & 11). Recombinant LukAB heterodimer in the absence or presence of Luk17 FN3 was incubated in a deuterated water solution for predetermined times resulting in deuterium incorporation at exchangeable hydrogen atoms. Regions bound to the Luk17 FN3 protein were inferred to be those sites relatively protected from hydrogen-deuterium exchange and thus contain a lower fraction of deuterium than the reference LukAB protein in studies in which more than 99% of the LukAB protein was mapped to specific peptides.

Procedures.

Pepsin/protease type XIII digestion and LC-MS: for pepsin/protease type XIII digestion, 5 µg of LukAB in 125 µL control buffer (50 mM phosphate, 100 mM sodium chloride at pH 7.4) was denatured by adding 63 µL of 5 M guanidine hydrochloride (final pH 2.5) and incubating the mixture for 3 min. The mixture was then subjected to on-column pepsin/protease type XIII digestion and the resultant peptides were analyzed using an Ultra Performance Liquid Chromatography Mass Spectrometry (UPLC-MS) system comprised of a Waters Acquity UPLC coupled to a Q Exactive™ Hybrid Quadrupole-Orbitrap Mass Spectrometer (Thermo). The peptides were separated on a 50 mm×1 mm C8 column with a 16.5 min gradient from 2-32% solvent B (0.1% formic acid in acetonitrile). Solvent A was 0.02% trifluoroacetic acid and 0.08% formic acid in water. The injection valve and pepsin/protease type XIII column and their related connecting tubes were housed inside a cooling box maintained at 11° C. And the second switching valve, C8 column and their related connecting stainless steel tubes were housed inside a chilled circulating box maintained at 0° C. Peptide identification was done through searching MS/MS data against the LukAB sequence using the Mascot software package (Koenig et al., "Robust prediction of the MASCOT score for an improved quality assessment in mass spectrometric proteomics," *J. Proteome Res.* 7 (9): 3708-17 (2008), which is hereby incorporated by reference in its entirety). The mass tolerance for the precursor and product ions was 20 ppm and 0.05 Da, respectively.

H/D Exchange: 5 µL LukAB (10 µg) or 5 µL of the complex of LukAB and Luk17 FN3 protein (10 & 7.35 rig, respectively) were incubated with 120 µL deuterium oxide labeling buffer (50 mM phosphate, 100 mM sodium chloride at pH 7.4) for 0 sec, 60 sec, 300 sec, 1800 sec, 7200 sec, and 14400 sec. Deuterium exchange was quenched by adding 63 µL of 5 M guanidine hydrochloride (final pH is 2.5) and the quenched sample was then subjected to on-column pepsin/protease type XIII digestion and LC-MS analysis as described above. The mass spectra were recorded in MS only mode. Raw MS data was processed using HDX WorkBench software for the analysis of H/D exchange MS data (Pascal et al., "Software for the Analysis of H/D Exchange MS Data," *J Am. Soc. Mass Spectrometry* 23 (9), 1512-1521 (2012), which is hereby incorporated by reference in its entirety). The deuterium levels were calculated using the average mass difference between the deuterated peptide and its native form (to).

Results.

Figure 19A:
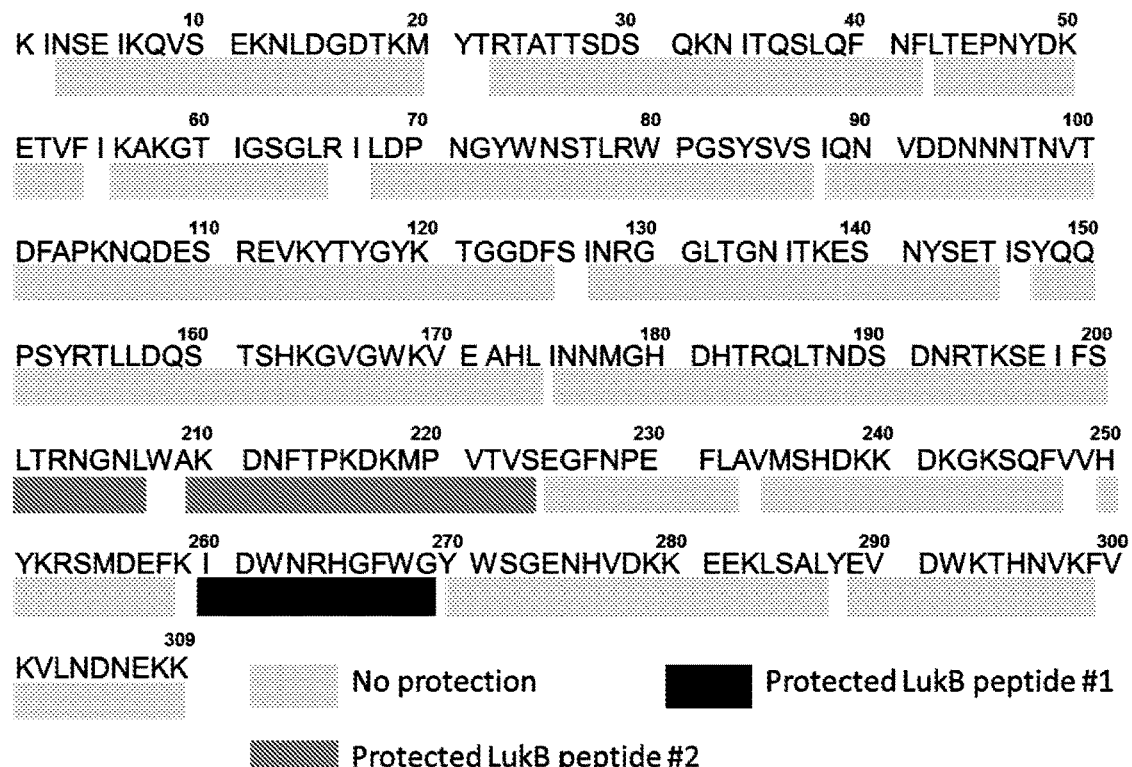
FIGS. 19A-19B depict the interaction of a LukAB-specific FN3 protein (Luk17 FN3) with LukAB as determined by solution phase hydrogen/deuterium exchange (HDX)-Mass Spectrometry (MS).
Figure 19B:
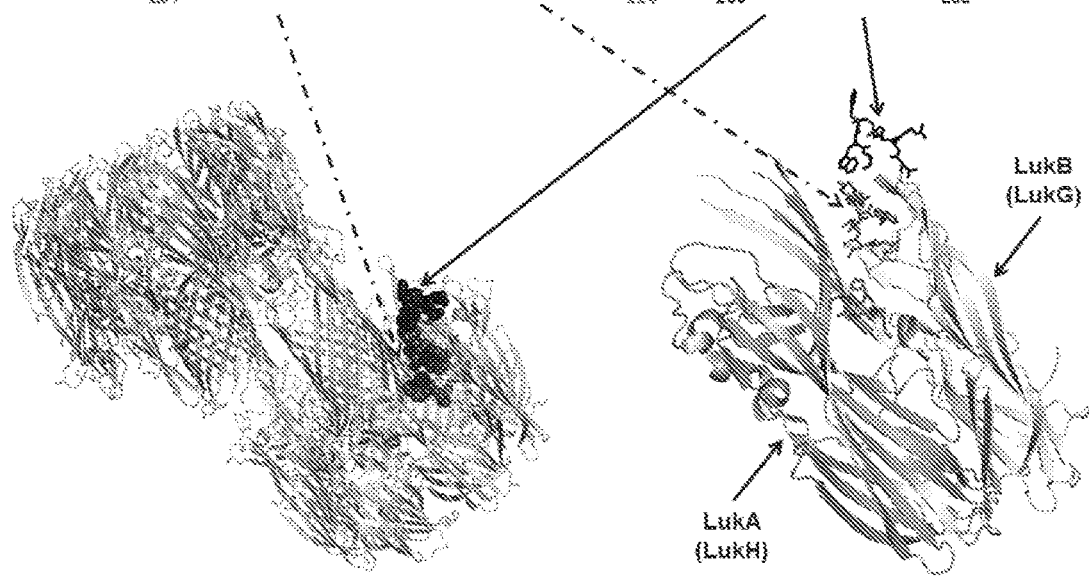

To establish at the peptide level interaction site(s) on LukAB targeted by the Luk17 FN3 protein, LukAB was incubated in deuterium oxide either alone or in complex with the Luk17 FN3 protein. The deuterium exchange was carried at room temperature for 0 s, 60 sec, 300 sec, 1800 sec, 7200 sec, and 14400 sec. The deuterium levels of the identified peptides were monitored from the mass shift on LC/MS. LukA did not show any significant reduction in deuterium uptakes upon binding to the Luk17 FN3 protein. In contrast, while most of the LukB peptides displayed identical or similar deuterium levels with and without the Luk17 FN3 protein molecule, two discrete peptides of LukB had significant decreased deuterium incorporation upon Luk17 FN3 protein binding. Specifically, the LukB peptide region $_{260}$IDWNRHGFWG$_{269}$ (amino acid residue 260-269 of SEQ ID NO: 11) experienced strong deuterium protection. This strongly protected region is thus assigned as a potential component of the epitope for the Luk17 FN3 protein. In addition, the HDX-MS analysis also showed one marginally protected segment, $_{201}$LTRNGNLWAKDNFTP-KDKMPVTVS$_{224}$ (amino acid residues 201-224 of SEQ ID NO: 11). These two regions protected by solution phase interaction of the Luk17 FN3 protein with LukB (SEQ ID NO: 11) are highlighted in black ($_{260}$IDWNRHGFWG$_{269}$;

peptide #1) and dark grey ($_{201}$LTRNGNLWAKDNFTPKD-KMPVTVS$_{224}$; peptide #2) in the differential LukB heat map schematic shown in FIG. 19 A.

These two putative LukAB/Luk17 FN3 protein interaction sites were mapped onto the published octameric crystal structure of the bi-component toxin LukAB (aka, LukGH) (Badarau et al., "Structure-Function Analysis of Heterodimer Formation, Oligomerization, and Receptor Binding of the *Staphylococcus aureus* Bi-component Toxin LukGH," *J. Biol. Chem.* 290, 142-156 (2015), which is hereby incorporated by reference in its entirety) and are shown in FIG. 19 B. Interestingly, the two identified linear peptides of LukB lie in close proximity to each other in the three dimensional crystal structure. This conclusion is further substantiated by mapping of the same peptides on a heterodimeric LukAB structure described herein (see EXAMPLE 21). These data suggest that the LukAB neutralization epitope of the Luk17 FN3 protein is defined by residues encompassed within the LukB peptide sequences $_{260}$IDWNRHGFWG$_{269}$ and $_{201}$LTRNGNLWAKDNFTPKDKMPVTVS$_{224}$ (of SEQ ID NO: 11).

Summary.

These data indicate that the Luk17 FN3 protein binds LukAB via specific interaction(s) with the LukB subunit. Based on models for the association of LukAB with the target cell receptor CD11b (Badarau et al., "Structure-Function Analysis of Heterodimer Formation, Oligomerization, and Receptor Binding of the *Staphylococcus aureus* Bi-component Toxin LukGH," *J. Biol. Chem.* 290, 142-156 (2015), which is hereby incorporated by reference in its entirety) (see EXAMPLE 21) and subsequent association at the target cell membrane in forming an octameric pore, it is assumed that Luk17 FN3 protein mediated neutralization of the cytolytic activity of LukAB occurs through perturbation of LukAB binding to target cells and/or the conformational transitions of LukAB associated with octameric pore formation in target cell membranes.

Example 20: Identification of Potential LukED Neutralization Epitopes on the Leukocidin LukE Subunit by Solution Phase Hydrogen/Deuterium Exchange (HDX)-Mass Spectrometry (MS)

Herein are described studies to identify the potential binding epitope(s) for the Luk26 FN3 protein (SEQ ID NO: 25) on the LukE subunit structure by solution phase HDX-MS methods using recombinant LukE protein produced from *Staphylococcus aureus* (SEQ ID NO: 1055). In these studies, recombinant LukE protein in the absence or presence of the Luk26 FN3 protein was incubated in a deuterated water solution for predetermined times resulting in deuterium incorporation at exchangeable hydrogen atoms. Regions bound to the Luk26 FN3 protein were inferred to be those sites relatively protected from exchange and thus contain a lower fraction of deuterium than the reference LukE protein in studies in which more than 99% of the LukE protein was mapped to specific peptides.

Procedures.

Pepsin/protease type XIII digestion and LC-MS: for pepsin/protease type XIII digestion, 5 µg of LukE protein in 125 µL control buffer (50 mM phosphate, 100 mM sodium chloride at pH 7.4) was denatured by adding 63 µL of 5 M guanidine hydrochloride (final pH 2.5) and incubating the mixture for 3 min. The mixture was then subjected to on-column pepsin/protease type XIII digestion and the resultant peptides were analyzed using an Ultra Performance Liquid Chromatography Mass Spectrometry (UPLC-MS) system comprised of a Waters Acquity UPLC coupled to a Q Exactive™ Hybrid Quadrupole-Orbitrap Mass Spectrometer (Thermo). The peptides were separated on a 50 mm×1 mm C8 column with a 16.5 min gradient from 2-32% solvent B (0.1% formic acid in acetonitrile). Solvent A was 0.02% trifluoroacetic acid and 0.08% formic acid in water. The injection valve and pepsin/protease type XIII column and their related connecting tubes were housed inside a cooling box maintained at 11° C. And the second switching valve, C8 column and their related connecting stainless steel tubes were housed inside a chilled circulating box maintained at 0° C. Peptide identification was done through searching MS/MS data against the LukAB sequence using the Mascot software package (Koenig et al., "Robust prediction of the MASCOT score for an improved quality assessment in mass spectrometric proteomics,", *J. Proteome Res.* 7 (9): 3708-17 (2008), which is hereby incorporated by reference in its entirety). The mass tolerance for the precursor and product ions was 20 ppm and 0.05 Da, respectively.

H/D Exchange: 5 µL of LukE (5 µg) protein alone or 5 µL of LukE plus the Luk26 FN3 protein (5 and 3.93 µg, respectively) were incubated with 120 µL deuterium oxide labeling buffer (50 mM phosphate, 100 mM sodium chloride at pH 7.4) for 0 sec, 60 sec, 300 sec, 1800 sec, 7200 sec, and 14400 sec. Deuterium exchange was quenched by adding 63 µL of 5 M guanidine hydrochloride (final pH is 2.5) and the quenched sample was then subjected to on-column pepsin/protease type XIII digestion and LC-MS analysis as described above. The mass spectra were recorded in MS only mode. Raw MS data was processed using HDX Work-Bench software for the analysis of H/D exchange MS data (Pascal et al., "Software for the Analysis of H/D Exchange MS Data," *J. Am. Soc. Mass Spectrometry* 23 (9), 1512-1521 (2012), which is hereby incorporated by reference in its entirety). The deuterium levels were calculated using the average mass difference between the deuterated peptide and its native form (to).

Results.

To establish at the peptide level interaction site(s) on LukE targeted by the Luk26 FN3 protein, LukE was incubated in deuterium oxide either alone or in complex with the Luk26 FN3 protein. The deuterium exchange was carried at room temperature for 0 s, 60 sec, 300 sec, 1800 sec, 7200 sec, and 14400 sec. The deuterium levels of the identified peptides were monitored from the mass shift on LC/MS. While most of the LukE peptides displayed identical or similar deuterium levels with and without Luk26 Fn3 protein, two peptide segments showed significantly decreased deuterium incorporation upon binding. Specifically, LukE shows significant reduction in deuterium uptake upon binding to Luk26 Fn3 protein at peptide regions, $_{69}$TSFSDVK-GSGYELT$_{82}$ and $_{255}$LFPRTGIYAERKHNAFVNRNF$_{275}$— as per the amino acid numbering used in SEQ ID No: 1055 (these regions correspond to amino acid residues 86-99 of SEQ ID NO: 1054 and 272-292 of SEQ ID NO: 1054, respectively). These two regions protected by the Luk26 FN3 protein are highlighted in black in the differential heat map schematic shown in FIG. 20 A. These regions are thus assigned as the major interaction sites for the Luk26 Fn3 protein on LukE. In addition, the HDX-MS analysis also showed one marginally protected segment, $_{244}$YGRN$_{247}$ (of SEQ ID NO: 1055) and is highlighted in dark grey in the differential heat map schematic shown in FIG. 20 A. This region corresponds to amino acid residues 261-264 of SEQ ID NO: 1054)

These putative LukE/Luk26 FN3 protein interaction sites were mapped on the published high-resolution crystal structure of Luk E (Nocadello et al., "Crystal structures of the components of the *Staphylococcus aureus* leukotoxin ED" *Acta. Cryst. D*72: 113-120 (2016) PDB entry 3roh, which is hereby incorporated by reference in its entirety). These interaction sites were found to lie in close proximity to each other in the three dimensional structure (see highlighted regions of FIG. 20B) and comprise elements of the so-called 'rim' domain of LukE. Subsequent mutational mapping of LukE indicated that residues of each of the putative LukE/Luk26 FN3 protein interaction site impacted binding to the Luk26 FN3 protein (see EXAMPLE 23 infra).

Summary.

These data indicate that the Luk26 FN3 protein binds LukE via specific interaction(s) in the rim domain region and this binding is sufficient to neutralize the cytolytic (EXAMPLE 4) and hemolytic activity (EXAMPLE 19) of LukED. As the rim domains of leukotoxins are thought to be important for interaction with the lipid bilayer of target cell membranes and for interaction with specific target cell membrane-bound receptors, it is possible that the binding of the Luk26 FN3 protein to LukE perturbs either receptor engagement, membrane binding and/or the formation of LukED heterodimers and/or higher oligomers at the surface of the membrane. In the case of LukED, Luk26 FN3 protein mediate blocking of receptor engagement could occur via perturbation of interaction with the Duffy antigen receptor for chemokines (DARC) on red blood and endothelial cells (Spaan et al., "*Staphylococcus aureus* Targets the Duffy Antigen Receptor for Chemokines (DARC) to Lyse Erythrocytes," *Cell Host Microbe* 18(3):363-70 (2015), which is hereby incorporated by reference in its entirety) or via perturbation of interactions with the chemokine receptors CXCR1 and CXCR2 on neutrophils (Spaan et al., "*Staphylococcus aureus* Leukotoxin ED Targets the Chemokine Receptors CXCR1 and CXCR2 to Kill Leukocytes and Promote Infection,", *Cell Host Microbe* 14(4): 453-459 (2013), which is hereby incorporated by reference in its entirety).

Example 21: Characterization of the Neutralization Epitope of the Luk17 FN3 Protein on LukAB by X-Ray Crystallography Herein are described studies to identify the binding epitope for the Luk17 FN3 protein on leukotoxin LukAB by determination of a high resolution X-ray crystal structure of a ternary complex (1:1:1) comprised of the Luk17 FN3 protein, LukAB and a LukAB-specific Fab (fragment, antigen-binding).

Procedures.

Proteins. The proteins used for the structural studies described herein are (i) a recombinant toxoid variant (LukA E323A) of LukAB protein produced from *Staphylococcus aureus* (SEQ ID NOs: 10 & 11) referred to herein as 'LukAB', (ii) a poly-histidine tagged variants of the Luk17 FN3 protein (SEQ ID NO: 1053) referred to herein as 'S17', and (iii) a recombinant Fab (SEQ ID NOs: 1078 HC plus 1079 LC; construct 34 in Table 1) derived from a LukAB-specific mAb (SEQ ID NOs: 1080 HC plus 1081 LC; construct 35 in Table 1) and herein referred to as '214F'. LukAB was purified at a final concentration of 5 mg/mL in 10 mM Na acetate, pH 5.5. The Luk17 FN3 protein purified at a final concentration of 8.4 mg/mL in 25 mM Tris, pH 7.4, 50 mM NaCl. 214F was purified at a final concentration of 1.91 mg/mL in 20 mM MES, 200 mM NaCl, pH 6.0.

Complex Formation, Crystallization and X-Ray Data Collection.

A ternary complex consisting of LukAB, the Luk17 FN3 protein and 214F was prepared by incubation of LukAB with excess Luk17 FN3 and 214F. The complex was purified by cation exchange chromatography on a Mono S5/50 GL column (GE Healthcare) pre-equilibrated in 20 mM HEPES pH 7.5, 10% glycerol. After loading the sample on the column, the ternary complex was eluted with a linear gradient of 20 mM HEPES pH 7.5, 10% glycerol, 1 M NaCl. Fractions were analyzed by SDS-PAGE to confirm the presence of the ternary complex. Fractions containing the purified LukAB/Luk17 FN3/214F complex were pooled and concentrated to 13.42 mg/mL in 20 mM HEPES pH 7.5, 100 mM NaCl, 10% glycerol. Crystallization screening and optimization was performed using a Mosquito crystallization robot (TTP Labtech) with seeding using seeds of the ternary complex. A crystal was harvested from 0.1 M MES pH 6.5, 26% PEG 3350, 0.2M diammonium tartrate and mixed with cryoprotectant solution composed of 0.1 M MES pH 6.5, 25% PEG 3350, 0.2 M diammonium tartrate, 20% glycerol. The crystal was flash-cooled in liquid nitrogen. The diffraction data were collected at Advanced Photo Source (beamline 17-ID) at the Argonne National Laboratory. The X-ray data were processed with "XDS" (Kabsch, W., *Acta. Crystallogr. D. Biol. Crystallogr.* 66(2): 125-132 (2010), which is hereby incorporated by reference in its entirety) to a resolution of 3 Å. The details of the X-ray data are summarized in Table 2 below.

Structure Determination.

The structure of the ternary complex was solved by molecular replacement with Phaser (Read, "Pushing the boundaries of molecular replacement with maximum likelihood," *Acta. Crystallogr. D. Biol. Crystallogr.* 57(10): 1373-1382 (2001), which is hereby incorporated by reference in its entirety) in several steps. The LukAB dimer from pdb ID 4tw1 (Badarau et al., "Structure-Function Analysis of Heterodimer Formation, Oligomerization, and Receptor Binding of the *Staphylococcus aureus* Bi-component Toxin LukGH," *J. Biol. Chem.* 290, 142-156 (2015), which is hereby incorporated by reference in its entirety) was used as a template after the pore forming segments were manually removed. The 214F Fab was located using a homology model of the Fv generated in MOE (CCG, Montreal) and the two constant domains from 3na9 (Luo et al., "Coevolution of antibody stability and Vkappa CDR-L3 canonical structure," *J. Mol. Biol.* 402(4): 708-719 (2010), which is hereby incorporated by reference in its entirety). Finally, the S17 was located using a homology model based upon a monomer from pdb id 3tes (Jacobs et al., "Design of novel FN3 domains with high stability by a consensus sequence approach," *Protein Eng. Des. Sel.* 25(3): 107-117 (2012), which is hereby incorporated by reference in its entirety). Refinement was carried out with Phenix (Adams et al., "Recent developments in the PHENIX software for automated crystallographic structure determination," *J. Synchrotron Radiat.* 11(1): 53-55 (2004), which is hereby incorporated by reference in its entirety) and model fitting with COOT (Emsley et al., "Coot: model-building tools for molecular graphics," *Acta. Crystallogr. D. Biol. Crystallogr.* 60(12 Pt 1): 2126-2132 (2004), which is hereby incorporated by reference in its entirety). The refinement statistics are summarized in Table 2. All graphics was generated with Pymol (Schrodinger LLC., www.pymol.org) and all other calculations were carried out in CCP4 (Collaborative Computational Project 1994).

TABLE 2

X-ray data statistics and refinement statistics for high resolution X-ray crystal structure of a ternary complex (1:1:1) comprised of the Luk17 FN3 protein, LukAB and a LukAB-specific

| Data collection | |
| --- | --- |
| Wavelength (Å) | 1.000 (APS) |
| Temperature (K) | 95 |
| Space group | C 222$_1$ |
| Unit cell axes (Å) | 92.98, 173.74, 174.31 |
| Unit cell angles (°) | 90, 90, 90 |
| Molecules/asymmetric unit | 1 LukAB/S17/214F complex |
| Resolution (Å) | 50-3.00 (3.08-2.80)* |
| No. measured reflections | 106,449 (7,215) |
| No. unique reflections | 27,208 (1,888) |
| Completeness (%) | 95.0 (90.5) |
| Redundancy | 3.9 (3.8) |
| R$_{merge}$ | 0.150 (1.000) |
| R$_{p.i.m.}$ | 0.079 (0.515) |
| CC1/2 | 0.99 (0.62) |
| <I/σ> | 10.5 (1.9) |
| B-factor (Wilson) (Å$^2$) | 63.8 |
| Structure Refinement | |
| Resolution (Å) | 49.16-3.00 (3.11-3.00) |
| No. reflections in refinement | 27,197 (2,604) |
| Number of atoms | 8,641 |
| Number of solvent atoms | 0 |
| R$_{cryst}$ (%) | 19.6 (32.4) |
| R$_{free}$ (5% data) (%) | 24.7 (38.8) |
| RMSD bond lengths (Å) | 0.003 |
| RMSD bond angles (°) | 0.53 |
| RMS B-factor bonded (Å$^2$) | 9.2 |
| Mean B factors (Å$^2$) | 63.6 |
| Ramachadran plot | |
| Favored (%) | 94.2 |
| Allowed (%) | 5.6 |
| Outliers (%) | 0.2 |

*Values for highest resolution shell are in ( )'s.
Fab (fragment, antigen-binding) designated '214F'

Results.

Figure 21A:
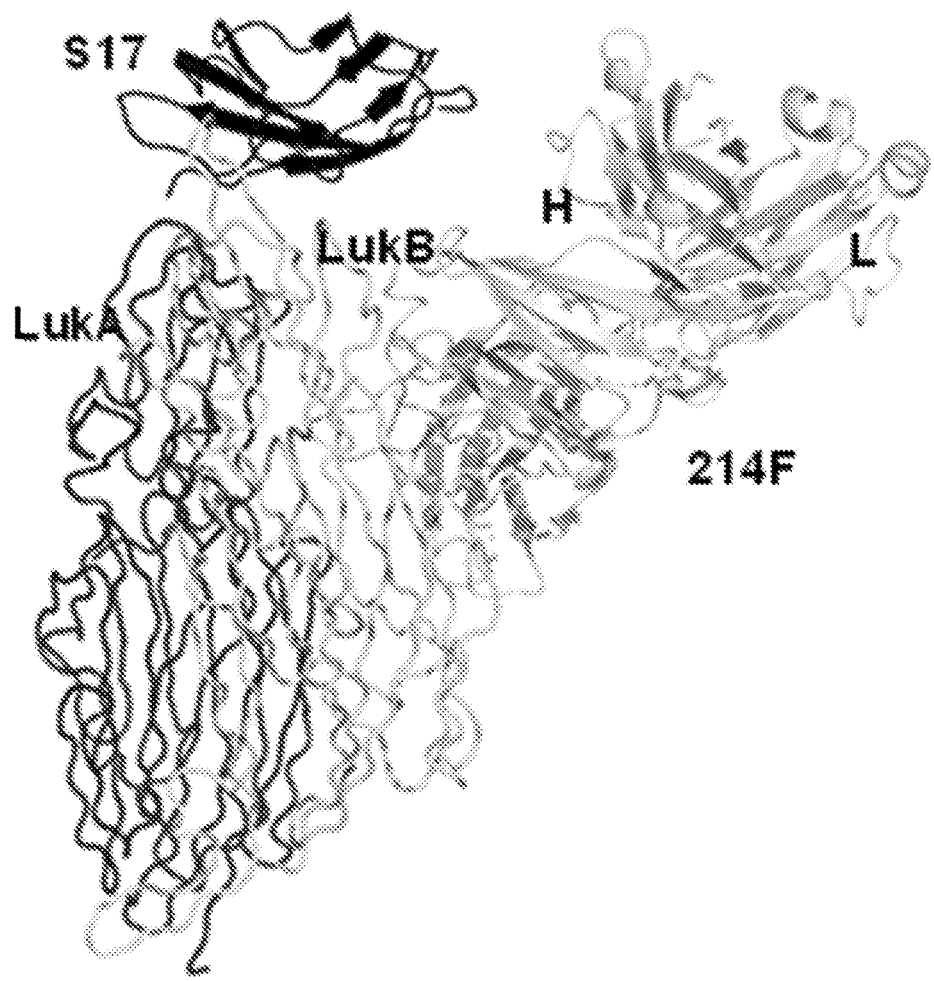

The overall structure of the LukAB/S17/214F ternary complex is shown in FIG. 21A. The structural model includes one LukAB heterodimer (residues of 16-305 of LukA, residues 41-323 of LukB—numbering as per PDB ID 4tw1), one 214F molecule (residues 1-213 of the light chain, residues 1-224 of the heavy chain) and one S17 molecule (residues 1-94 of centyrin S17 including the initiation methionine (Ml) and two His residues of the C-terminal 6x-His Tag)).

Figure 21B:
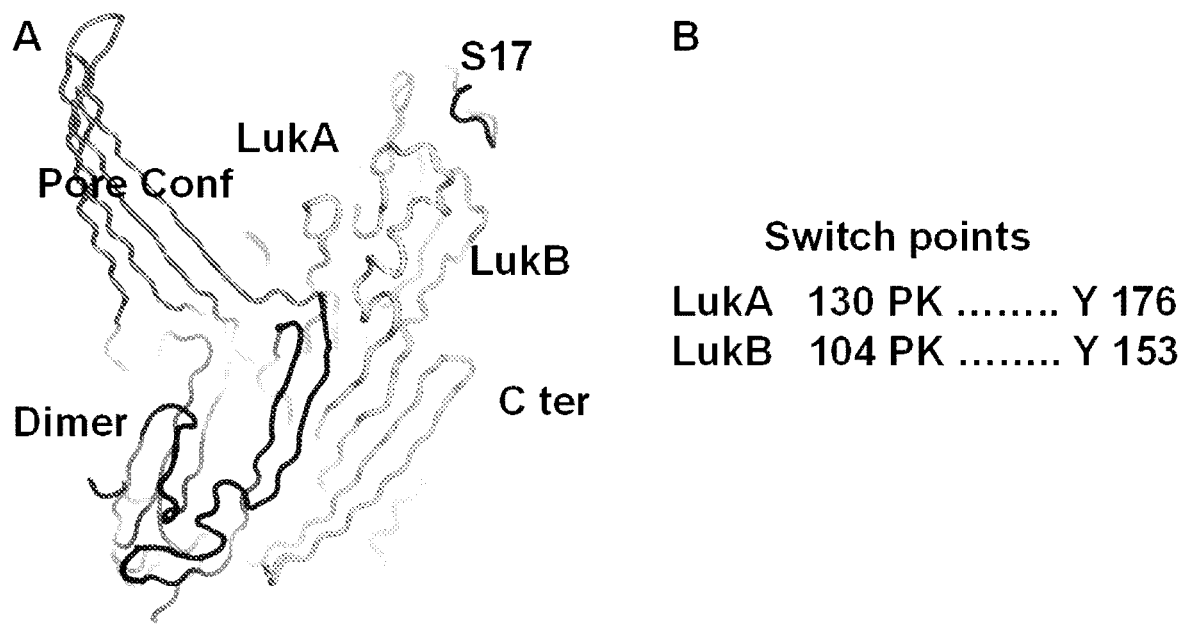

The LukAB in the ternary complex is a heterodimer with the LukA/LukB interface corresponding to interface 2 of the previously determined LukAB structure and is consistent with a published mutational analysis of the subunit interface (Badarau et al., "Structure-Function Analysis of Heterodimer Formation, Oligomerization, and Receptor Binding of the *Staphylococcus aureus* Bi-component Toxin LukGH," *J. Biol. Chem.* 290, 142-156 (2015, which is hereby incorporated by reference in its entirety). The LukA and LukB monomer structures are very similar to those in the octamer structure (rmsds of 0.36 Å for 223 LukA Cα atoms and 0.34 Å for 224 LukB Cα atoms, respectively) except for the loop segments involved in the octamer formation. As is shown in FIG. 21B, the pore-forming segments (residues 132-175 and 106-153 of LukA and LukB, respectively) adopt very different conformations in the isolated dimer. Interestingly, the switch points for the two conformations in LukA and LukB are identical in sequence as well as structure.

Figure 21C:
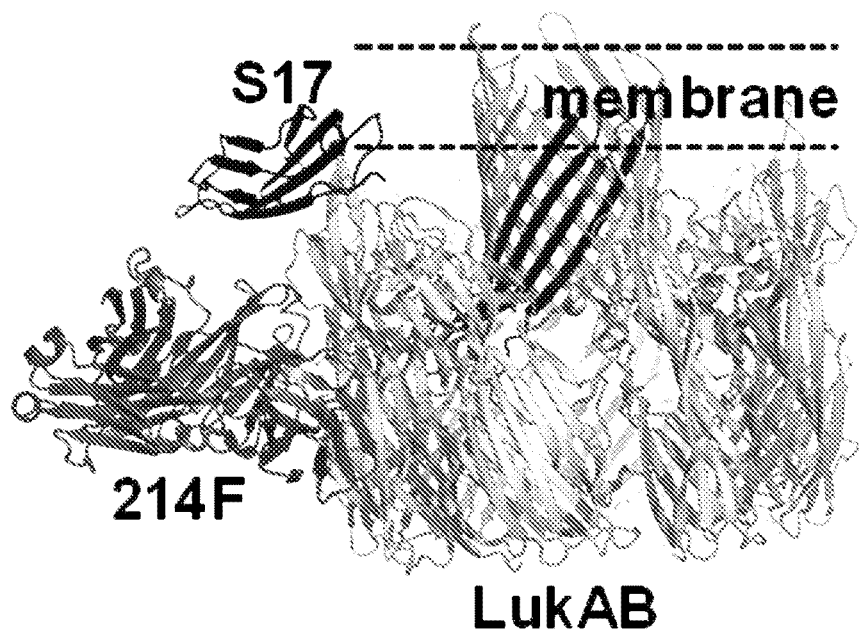

The binding sites for S17 and Fab 214F on LukAB are distant from the switching segments; FIG. 21C. Thus, both molecules should be capable of binding the LukAB octamer as well as the LukAB heterodimer. The parental mAb of Fab 214F is known not to exhibit neutralizing activity against LukAB. In contrast, S17 exhibits LukAB neutralizing activity (EXAMPLE 5). Based on the localization of the S17 epitope on the octameric structure (FIG. 21C), it seems likely that S17 perturbs interaction with host cells either by blocking interaction with host cell receptors or sterically preventing insertion of the octameric pore into the membrane.

Figure 21F:
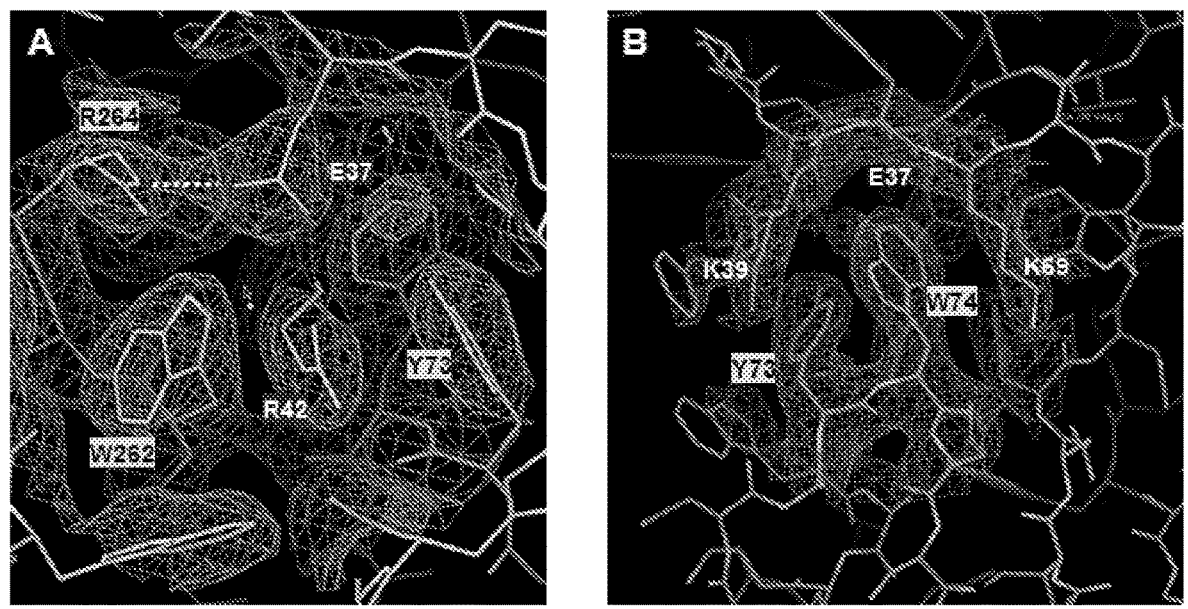

S17 binds the so-called rim domain of the LukB subunit (FIGS. 21A-21B) and does not make any apparent contact with the LukA subunit. Based on S17/LukB crystal contacts, the S17 binding epitope on LukAB is minimally composed of LukB residues: Y73, W74, N191, N192, R193, K195, N206, L207, W208, W262, N263, R264, H265, G266, F267, Y270 of SEQ ID NO: 11 (FIG. 21D). These epitope residues are largely consistent with the epitope segments identified by HDX mapping (EXAMPLE 19) and are also consistent with mutational analysis results (EXAMPLE 22). FIG. 21F shows representational electron density at the LukB epitope/ Luk17 FN3 paratope interface.

S17 binds LukB via amino acid residues exposed on its concave surface corresponding to residues that are variant with respect to the parental FN3 binding protein (SEQ ID NO: 1). Based on S17/LukB crystal contacts, the residues that define the S17 paratope for binding LukB are Ml, W33, T35, E37, K39, F40, Y41, R42, A45, V47, E67, K69, W71, V73, W82 & P83 and are highlighted in FIG. 21E. These structural paratope residues are also consistent with mutational studies (EXAMPLE 5 & FIG. 5; note that the S17 numbering is shifted herein by one residue from EXAMPLE 5 as the amino-terminal methionine is included). Of note, key Luk17 FN3 paratope residues identified via the analysis on the LukAB binding and neutralization of site-directed variants of the Luk17 FN3 protein (see EXAMPLE 5 & FIG. 5) align with Luk17 FN3 paratope residues identified in the crystal structure. For example, Arg42, Glu37 and Lys39 in Luk17 FN3 (SEQ ID No: 1053; corresponding to Arg41, Glu36 and Lys38 in SEQ ID No: 14 and EXAMPLE 5) make specific crystal contacts with residues of the identified LukAB neutralization epitope for Luk17 FN3.

Summary.

The structure of the LukAB/S17/214F ternary complex reveals a complete LukAB heterodimer with the octamer-forming segments in very different conformations from those observed in a previously published octameric LukAB structure (Badarau et al., "Structure-Function Analysis of Heterodimer Formation, Oligomerization, and Receptor Binding of the *Staphylococcus aureus* Bi-component Toxin LukGH," *J. Biol. Chem.* 290: 142-156 (2015), which is hereby incorporated by reference in its entirety). The structurally defined epitope for the S17 (Luk17 FN3) protein on LukB is consistent with data from solution phase HDX mapping studies of LukAB (EXAMPLE 19) and the characterization of site-directed variants of LukB (EXAMPLE 22). Finally, the structure may also indicate an interesting neutralization mechanism for S17 wherein the interaction of LukAB with the target cell receptor (CD11b) and/or cell membrane is sterically blocked. In addition, it is possible that S17 binding prevents the normal conformational changes LukAB undergoes in transitioning from a heterodimer to an octameric, membrane embedded pore.

Example 22: Mutational Mapping of LukB to Confirm the LukAB Neutralization Epitope of the Luk17 FN3 Protein Further to the characterization of site-directed mutants of the Luk17 FN3 protein in terms of LukAB binding and neutralization characteristics (EXAMPLE 5), herein are described equivalent studies to confirm specific Luk17 FN3/LukB interactions at the paratope/epitope interface as identified by determination of a high resolution X-ray crystal structure of a ternary complex (1:1:1) comprised of the Luk17 FN3 protein, LukAB and the '214F' LukAB-specific Fab (see EXAMPLE 21).

Procedures.

The proteins used for the studies described herein are (i) site-directed LukB mutant variants of a recombinant toxoid variant of the LukAB protein (LukA E323A) that bear poly-histidine and streptavidin binding sequences at the amino-terminus of the LukA sequence and correspond to SEQ ID NOs: 1033-1052 (LukB variants) combined with SEQ ID NO: 1021 (LukA), and (ii) a variant of the Luk17 FN3 protein that bears a carboxyl-terminal poly-histidine sequence (SEQ ID NO: 1053). Recombinant LukAB variants were purified by nickel affinity chromatography as soluble heterodimers from an E. coli strain expressing biotin ligase. The Luk17 FN3 protein was purified from E. coli by nickel affinity chromatography.

Determination of Affinity ($K_D$) and Dissociation ($K_{dis}$) Constants.

$K_D$ and $K_{dis}$ values for the LukAB variants bearing site-directed mutations in LukB were determined by Bio-Layer Interferometry (BLI) using an Octet$^{RED}$ 384 instrument (forteBIO Inc.) running the basic kinetics protocol ("Biomolecular Binding Kinetics Assays on the Octet Platform", at outlined in Application Note 14 from Pall forteBIO Corp. accessible via the ForteBIO websiste, which is hereby incorporated by reference in its entirety). Briefly, biotinylated LukAB mutant proteins were loaded onto Dip and Read™ Streptavidin (SA) Biosensor pins at a 10 µg/mL concentration in PBS pH7.2 for 10 minutes. A baseline was then set by washing with phosphate buffered saline (PBS, pH 7.2) for 1 minute. The association rate for the Luk17 FN3 protein was then measured by addition of a 10 ug/mL concentration in PBS (pH7.2) over a period of 10 minutes. The Luk17 FN3 protein dissociation rate was then measured following washing with PBS (pH7.2) for 5 minutes. Curve fitting to determine $K_D$ values used the initial 60 seconds of association and dissociation steps to analyze on and off rates.

Results.

Figure 22A:
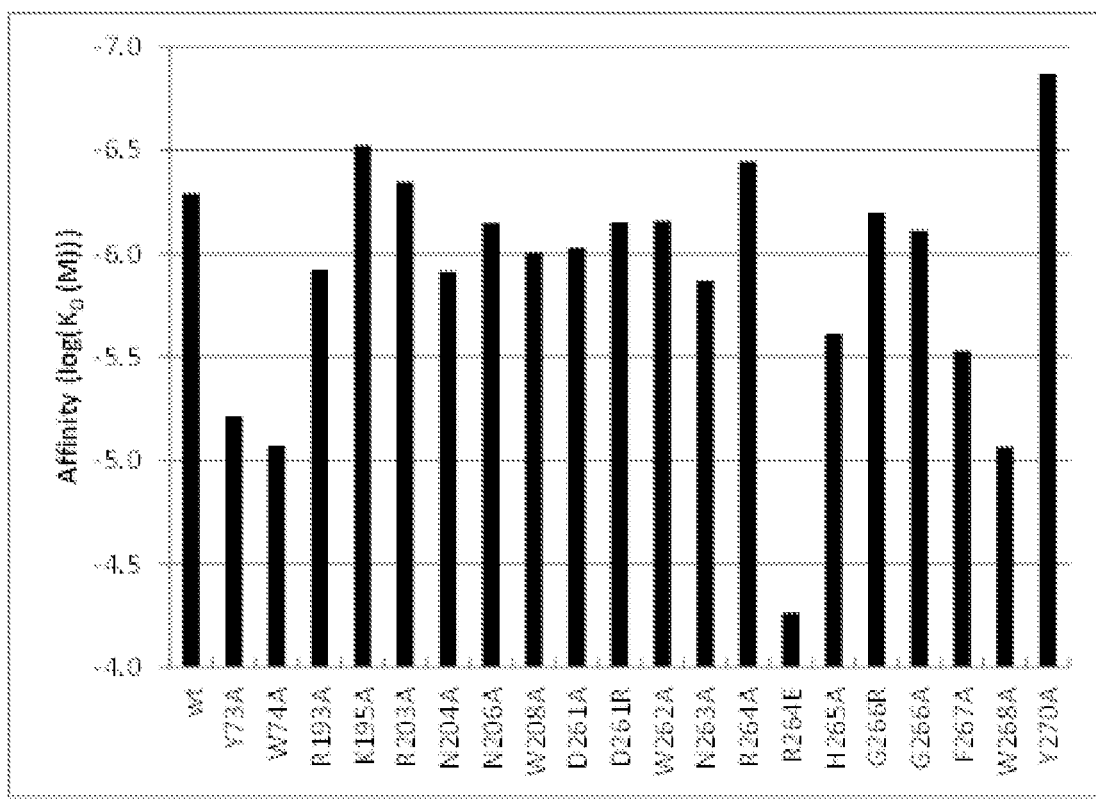
FIGS. 22A-22B depict the mutational mapping of LukB to confirm the neutralization epitope of the Luk17 FN3 protein.
Figure 22B:
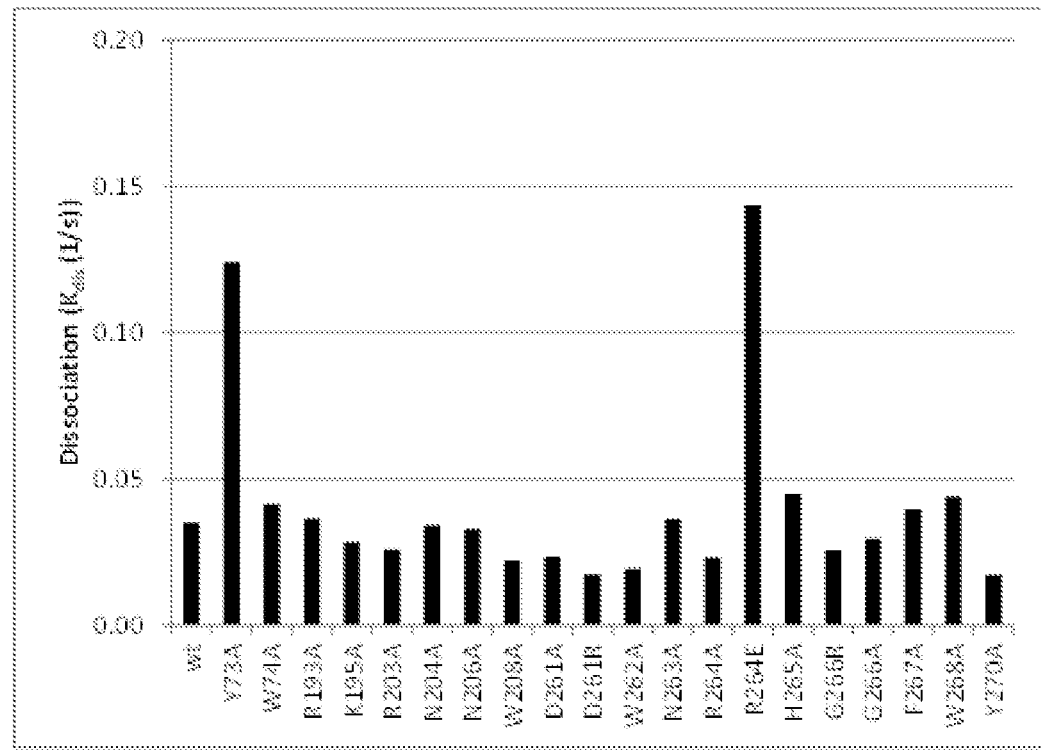

Based on Luk17 FN3/LukB crystal contacts, the Luk17 FN3 binding epitope on LukAB is minimally composed of LukB residues: Y73, W74, N191, N192, R193, K195, N206, L207, W208, W262, N263, R264, H265, G266, F267, Y270 of SEQ ID NO: 11 (FIG. 21D). FIGS. 22A and 22B, respectively, show the calculated affinity ($K_D$) and dissociation ($K_{dis}$) constants for a series of LukAB variants in which LukB epitope residues were mutated to either X or Y with residue numbering consistent with the LukAB structure from pdb ID 4tw1 (Badarau et al., "Structure-Function Analysis of Heterodimer Formation, Oligomerization, and Receptor Binding of the Staphylococcus aureus Bi-component Toxin LukGH," J. Biol. Chem. 290, 142-156 (2015), which is hereby incorporated by reference in its entirety).

Considering the extent of the of the Luk17 FN3/LukB interaction surface as identified in the LukAB/Luk17 FN3 (S17)/214F crystal structure (EXAMPLE 21), it was not anticipated that individual site-directed (substitution) mutants of either the LukB epitope or the Luk17 FN3 protein paratope would negate binding in total. However, it was anticipated that mutations that disrupt key paratope-epitope interactions would have a significant impact on the affinity of the interaction between LukAB and the Luk17 FN3 protein. Of the LukB site-directed mutants evaluated, Tyr73Ala, Trp74Ala, Arg264Glu and Trp268Ala were observed to have the most significant impact on Luk17 FN3 affinity (as reflected in $K_D$ values; FIG. 22A) with Tyr73Ala and Arg264Glu exhibiting the most significant impact on dissociation characteristics (as reflected in $K_{dis}$ values; FIG. 22B).

Summary.

Mutational analysis of the Luk17 FN3 (S17) protein binding characteristics of LukAB variants described herein substantiate the importance of LukB residues identified via X-ray crystallization studies of the LukAB/S17/214F ternary complex as key components of the LukAB neutralization epitope of the Luk17 FN3 (S17) protein (EXAMPLE 21). Of the LukB site-directed mutants evaluated, Tyr73Ala, Trp74Ala, Arg264Glu and Trp268Ala were observed to have the most significant impact on Luk17 FN3 affinity (as reflected in $K_D$ values) with Tyr73Ala and Arg264Glu exhibiting the most significant impact on dissociation characteristics (as reflected in $K_{dis}$ values).

Example 23: Mutational Mapping of LukE to Confirm the LukED Neutralization Epitope of the Luk26 FN3 Protein Further to the characterization of site-directed mutants of the Luk26 FN3 protein in terms of LukE binding and LukED neutralization characteristics (EXAMPLE 4, FIG. 4A), herein are described equivalent studies to confirm specific Luk26 FN3/LukE interactions at the apparent paratope/epitope interface as identified by solution phase hydrogen/deuterium exchange (HDX)-Mass Spectrometry (MS) mapping (EXAMPLE 20).

Procedures.

The proteins used for the studies described herein are (i) site-directed mutant variants of a recombinant form of LukE that bears poly-histidine and streptavidin binding sequences at the amino-terminus of the LukE sequence (SEQ ID NO: 1056) and correspond to SEQ ID NOs: 1057-1076, and (ii) a variant of the Luk26 FN3 protein that bears a carboxyl-terminal poly-histidine sequence (SEQ ID NO: 1077). Recombinant LukE variants were purified by nickel affinity chromatography as soluble proteins from an E. coli strain expressing biotin ligase. The Luk26 FN3 protein was purified from E. coli by nickel affinity chromatography.

Determination of Affinity ($K_D$) and Dissociation ($K_{dis}$) Constants.

$K_D$ and $K_{dis}$ values for the LukED variants bearing site-directed mutations in LukE were determined by Bio-Layer Interferometry (BLI) using an Octet$^{RED}$ 384 instrument (forteBIO Inc.) running the basic kinetics protocol ("Biomolecular Binding Kinetics Assays on the Octet Platform", at outlined in Application Note 14 from Pall forteBIO Corp. accessible via the ForteBIO website, which is hereby incorporated by reference in its entirety). Briefly, biotinylated LukE mutant proteins were loaded onto Dip and Read™ Streptavidin (SA) Biosensor pins at a 10 µg/mL concentration in PBS pH7.2 for 10 minutes. A baseline was then set by washing with phosphate buffered saline (PBS, pH 7.2) for 1 minute. The association rate for the Luk26 FN3 protein was then measured by addition of a 10 ug/mL concentration in PBS (pH7.2) over a period of 10 minutes. The Luk26 FN3 protein dissociation rate was then measured following washing with PBS (pH7.2) for 5 minutes. Curve fitting to determine $K_D$ values used the initial 60 seconds of association and dissociation steps to analyze on and off rates.

Results.

Figure 23A:
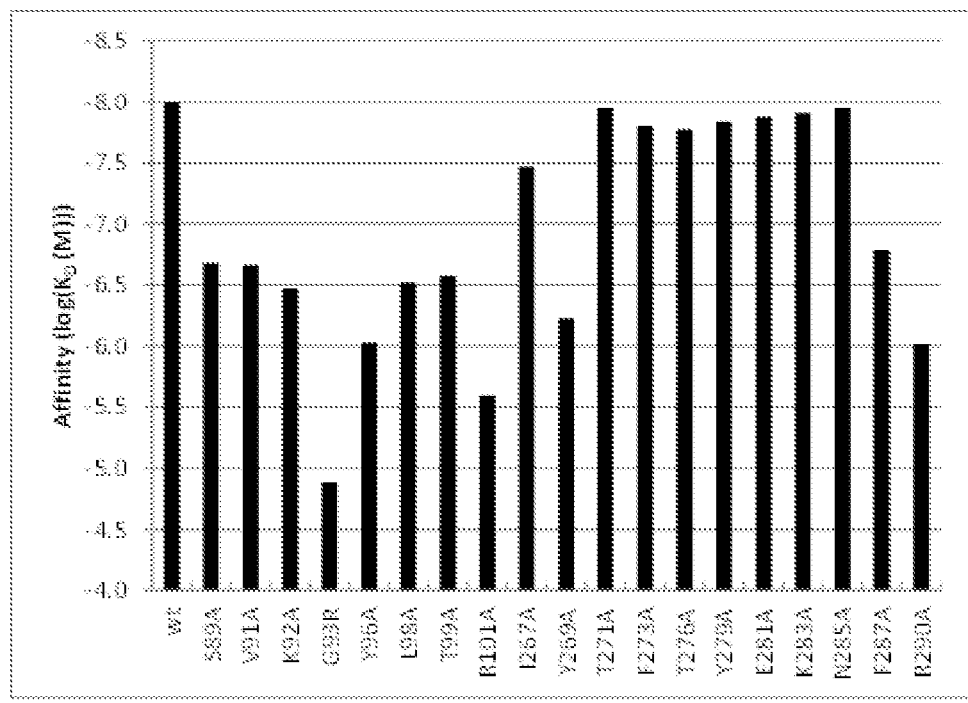
Figure 23B:
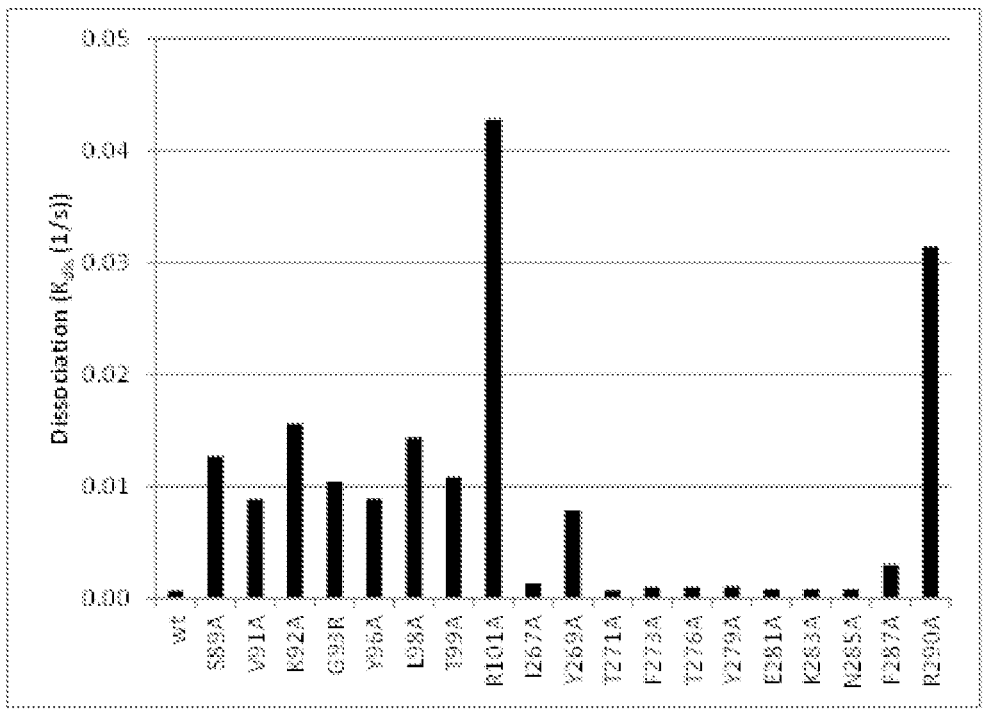

Based on the LukE residues identified as potential components of the Luk26 FN3 binding epitope by HDX mapping (FIG. 20A) and mapping of putative LukED neutralization epitopes onto the published crystal structure of LukE (FIG. 20B), a series of site-directed (substitution) mutants of LukE were prepared and characterized in terms of their binding to the Luk26 FN3 protein. Specifically, LukE variants were made in the LukE peptide regions $_{86}$TSFSDVK-GSGYELT$_{99}$ and $_{272}$LFPRTGIYAERKHNAFVNRNF$_{292}$ (as per the amino acid numbering used in PDB entry 3ROH; SEQ ID No: 1054). Considering the extent of the apparent Luk26 FN3/LukE interaction surface, it was not anticipated that individual site-directed (substitution) mutants of either the LukE epitope or the Luk26 FN3 protein paratope would negate binding in total. However, it was anticipated that mutations that disrupt key paratope-epitope interactions would have a significant impact on the affinity of the interaction between LukE and the Luk26 FN3 protein. Of the LukE site-directed mutants evaluated, mutations of residues corresponding to the peptide region $_{86}$TSFSDVK-GSGYELT$_{99}$ (as per SEQ ID NO: 1054) had the most consistent impact on Luk26 FN3 binding affinity (as reflected in lower $K_D$ values (FIG. 23A) and higher $K_{dis}$ values (FIG. 23B)) with the Ser89Ala, Val91Ala, Lys92Ala, Gly93Arg, Tyr96Ala, Leu98Ala and Thr99Ala mutant variants (numbering per SEQ ID NO: 1054) all exhibiting weaker binding compared to the wild-type (parental) LukE protein (FIGS. 23A-23B). In addition, this apparent epitope component may be extended beyond the linear LukE region identified by HDX mapping as an Arg101Ala variant of LukE was also found to exhibit significantly weaker Luk26 FN3 binding and enhanced dissociation characteristics. In contrast, mutation of residues in the $_{272}$LFPRTGIYAERKH-NAFVNRNF$_{292}$ peptide region in general had a less significant impact on Luk26 FN3 binding (FIGS. 23A-23B). However, the contribution of residues from this linear LukE sequence to the Luk26 FN3 epitope is apparent through the lower binding affinity and higher dissociation rate observed for the Tyr269Ala, Phe287Ala and Arg290Ala variants of LukE.

Localization of the specific residues inferred from these data to represent components of the LukE binding and LukED neutralization epitope for the Luk26 FN3 were mapped on the published crystal structure of LukE (Nocadello et al., "Crystal structures of the components of the *Staphylococcus aureus* leukotoxin ED," *Acta. Cryst. D*72: 113-120 (2016) which is hereby incorporated by reference in its entirety; PDB entry 3ROH) and are highlighted in schematic from in FIG. 23C. Of note, the identified epitope residues are localized to structural elements of the so-called rim domain of LukE. For clarity, alignment of the recombinant LukE sequences SEQ ID NOs: 1055 and 1056 with the sequence of the LukE protein of the published LukE structure (PDB entry 3ROH; SEQ ID NO: 1054) are included in FIG. 23C.

Summary.

Analysis of the Luk26 FN3 protein binding characteristics of the LukE variants described herein substantiate the importance of key residues in the rim domain of LukE in forming the LukE binding and LukED neutralization epitope for the Luk26 FN3 protein. Specifically, residues Ser89, Val91, Lys92, Gly93Arg, Tyr96, Leu98 and Thr99, Tyr269, Phe287 and Arg290 of SEQ ID NO: 1054 define a minimal epitope for the Luk26 FN3 protein. As the rim domains of leukotoxins are thought to be important for interaction with the lipid bilayer of target cell membranes and for interaction with specific target cell membrane-bound receptors, it is possible that the binding of the Luk26 FN3 protein to LukE perturbs either receptor engagement, membrane binding and/or the formation of LukED heterodimers and/or higher oligomers at the surface of the membrane. In the case of LukED, Luk26 FN3 protein mediate blocking of receptor engagement could occur via perturbation of interaction with the Duffy antigen receptor for chemokines (DARC) on red blood and endothelial cells (Spaan et al., "*Staphylococcus aureus* Targets the Duffy Antigen Receptor for Chemokines (DARC) to Lyse Erythrocytes," *Cell Host Microbe* 18(3): 363-70 (2015), which is hereby incorporated by reference in its entirety) or via perturbation of interactions with the chemokine receptors CXCR1 and CXCR2 on neutrophils (Spaan et al., "*Staphylococcus aureus* Leukotoxin ED Targets the Chemokine Receptors CXCR1 and CXCR2 to Kill Leukocytes and Promote Infection," *Cell Host Microbe* 14(4): 453-459 (2013), which is hereby incorporated by reference in its entirety).

Example 24: Definition of a Further Minimal Epitope for mAb 5133 and Characterization of the Interaction of mAb 5133 with N-Acetyl-D-Glucosamine as Determined by X-Ray Crystallography The specificity of mAb 5133 for glycosylated forms of recombinant variants of the *S. aureus* SdrC protein, a member of the Serine-Aspartate Repeat (SDR) family, was demonstrated in WO2015089073 to Torres et al., which is hereby incorporated by reference in its entirety. Specifically, following incubation of purified, recombinant SdrC proteins with whole cell lysates prepared from *S. aureus* strain JE2 (Fey et al., "A Genetic Resource for Rapid and Comprehensive Phenotype Screening of Nonessential *Staphylococcus aureus* Genes", *mBio* Volume 4 Issue 1 e00537-12 (2013), which is hereby incorporated by reference in its entirety), specific protein bands were detected via western blot in contrast to those detected following incubation with lysates prepared from *S. aureus* NE105, an otherwise-isogenic derivative of JE2 that lacks expression of the SdgB glycosyltransferase (see WO2015089073 at EXAMPLE 14, which is hereby incorporate by reference in its entirety). Further, incubation of purified, recombinant SdrC proteins with a recombinant form of the SdgB glycosyltransferase similarly yielded the mAb 5133 specific epitope in a manner that was dependent on the presence of uridine diphosphate N-acetylglucosamine (UDP-GlcNac) (PCT/US2014/069347; EXAMPLE 15).

In EXAMPLE 1 herein, the minimal epitope for mAb 5133 was further defined through studies of mAb5133 binding to a synthetic peptide in the presence or absence of in vitro glycosylation with recombinant *S. aureus* SdgB glycosyltransferase which indicated that (i) that the epitope target of mAb 5133 and mAb 5133-FN3 fusion proteins can be defined minimally as a peptide sequence containing as few as ten copies of the SD repeat sequence that has been modified by the *S. aureus* SdgB glycosyltransferase in the presence of UDP-GlcNac, and (ii) that no other sequences from the SdrC protein, or other *S. aureus* SDR family members [Clumping Factor A (ClfA), Clumping Factor B (ClfB), SdrD or SdrE], are necessary components of the minimal antigen epitope recognized by mAb 5133.

As demonstrated herein, that a minimal epitope for mAb 5133 can be further defined as a single GlcNac modified Serine residue in the context of a peptide comprised often SD repeat units. Further, specifics of the interaction of mAb 5133 with the GlcNac moiety are apparent from a high-resolution structure of the variable region of mAb 5133 determined in the presence of GlcNac.

Procedures.

Peptides, Proteins & Reagents.

For peptide studies, a series of twenty eight (28) residue peptides were synthesized and purified (New England Peptide, Inc., Gardner, Mass.) with the following sequences:

(i)
(SEQ ID NO: 670)
(N)-LC-Biotin-SDSDSDSDSDSDSDSDSDSDHHHHHHHH-(C)

referred to herein as the 'SD peptide';

(ii)
(SEQ ID NO: 1084)
(N)-LC-Biotin-TDTDTDTDTDTDTDTDTDTDHHHHHHHH-(C)

referred to herein as the 'TD peptide';

(iii)
(SEQ ID NO: 1085)
(N)-LC-Biotin-SDSDSDSDSDSDSDSDSDS$^{GlcNac}$DHHHHHHHH- (C) referred to herein as the 'SD-GlcNac peptide'.

Each peptide bears an eight residue poly-Histidine sequence and is additionally modified with an amino-terminal biotin moiety attached via a long chain (LC) linker. The 'SD-GlcNac peptide' was synthesized with a single GlcNac introduced on the carboxyl-terminal serine residue.

For in vitro glycosylation reactions, 100 g of either peptide was incubated with 4 µg of recombinant SdgB protein in 100 µL of 100 mM Tris pH 7.5 containing 10% glycerol and 30 µg of uridine diphosphate N-acetylglucosamine (UDP-GlcNac) at 37 C° for 1 hour. Analysis of the extent of in vitro glycosylation was determined by matrix-assisted laser desorption/ionization (MALDI) analysis. The binding of mAb 5133 to the SD, TD and SD-GlcNAc peptides (+/− in vitro SdgB mediated glycosylation) was determined using a plate-based ELISA format wherein the biotinylated peptides were captured on high binding 96-well ELISA plates (Nunc) coated with streptavidin at 5 µg/mL in PBS and incubated overnight at 4° C. Detection of bound test articles was performed using an HRP-conjugated F(ab')2 fragment donkey anti-human IgG (H+L) (Jackson Immunoresearch 709-006-149 lot 112932) and detection of streptavidin plate-bound SD peptide (+/− glycosylation) by use of an HRP-conjugated anti-polyhistidine antibody (R&D Systems MAB050H polyhistidine HRP MAb Clone AD1.1.10). POD Chemiluminescence substrate (Roche-cat#11582950001) was then added to the plates and absorbance was read immediately on the Perkin Elmer EnVision Multilabel Reader at 405 nm. The data were analyzed using GraphPad Prism. Values were transformed to a log scale and fit using a non-linear regression sigmoidal dose-response equation resulting in an eleven point binding curve for each antibody against the SD peptides (+/− glycosylation) antigen.

A recombinant form of the SdgB glycosyltransferase (SEQ ID NO: 99) was purified as described in EXAMPLE 1. SM1B229 (SEQ ID NOs: 1082 HC and 1083 LC; construct 36 in Table 1), a Fab variant of mAb 5133, was produced by transient expression in HEK 293 cells, and purified by Ni-affinity chromatography, SEC, and ion exchange in a final buffer of 20 mM MES pH 6.5, 0.15 M NaCl. N-Acetylglucosamine (GlcNAc) was purchased from Sigma-Aldrich (Catalog number A8625). For co-crystallization, the SM1B229 Fab was mixed with concentrated GlcNAc to a final concentration of 100 mM. The final sample was 16 mg/mL SM1B229 Fab in 20 mM MES pH 6.5, 0.15 M NaCl, 100 mM GlcNAc.

Crystallization.

Crystallization screening was performed with seeding using crystal seeds of SM1B229 Fab in 20% PEG 3350, 0.1 M ammonium nitrate, 0.1 M potassium formate.

Data Collection and Processing.

A crystal was harvested from 20.2% PEG3350, 0.2 M sodium fluoride and mixed with cryo-protectant solution composed of 21.6% PEG 3350, 0.2 M sodium fluoride, 20% glycerol. The crystal was flash-cooled in liquid nitrogen. The SM1B229+GlcNAc X-ray diffraction data were collected at the Advanced Photon Source (APS, Argonne National Laboratory on beamline IMCA-CAT and detected with a Pilatus 6M detector. Diffraction intensities were processed with the X-ray Detector Software (XDS) software package.

Structure Determination and Analysis.

Molecular replacement was performed using Phaser (Read, "Pushing the boundaries of molecular replacement with maximum likelihood," *Acta. Crystallogr. D. Biol. Crystallogr.* 57(10): 1373-1382 (2001), which is hereby incorporated by reference in its entirety) with a search model composed of the free SM1B229 Fab structure. Refinement was carried out with Phenix (Adams et al., "Recent developments in the PHENIX software for automated crystallographic structure determination", *J. Synchrotron Radiat.* 11(1): 53-55 (2004), which is hereby incorporated by reference in its entirety) and model fitting with COOT (Emsley et al., "Coot: model-building tools for molecular graphics," *Acta. Crystallogr. D. Biol. Crystallogr.* 60(12 Pt 1): 2126-2132 (2004), which is hereby incorporated by reference in its entirety). The refinement statistics are summarized in Table 3. All graphics was generated with Pymol (Schrodinger LLC., www.pymol.org) and all other calculations were carried out in CCP4 (Collaborative Computational project 1994). The SM1B229 Fab/GlcNac co-crystal structure was solved to 2.50 Å resolution.

TABLE 3 shows X-ray data statistics and refinement statistics for a structure determined for SM1B229 (a Fab variant of mAb 5133) in the presence of GlcNac

| Data collection | |
|---|---|
| Content | SM1B229 + GlcNAc |
| Mother Liquor | 20.2% PEG3350, 0.2M NaF |
| Cryo | 21.6% PEG 3350, 0.2M NaF, 20% glycerol |
| Source/Detector | APS IMCA-CAT/Pilatus 6M |
| Wavelength (Å) | 1.000 |
| Temperature (K) | 100 |
| Distance (mm) | 300 |
| Total rotation (°) | 180 |
| Exp (sec)/0.5° | 0.50 |
| Space group | P1 |
| Unit cell axes (Å) | 78.19, 81.42, 89.82 |
| Unit cell angles (°) | 84.422, 66.391, 69.181 |
| Molecules/asym. unit | 4 |
| $V_m$ (Å$^3$/Da)/solv. (%) | 2.45/50 |
| Resolution (Å) | 50-2.47 (2.53-2.47) |
| No. measured reflections | 76613 (2518) |
| No. unique reflections | 49804 (1746) |
| Completeness (%) | 72.9 (34.5) |
| Redundancy | 1.54 (1.44) |
| R-merge | 7.6 59.6 |
| $R_{p.i.m.}$ | 0.076 |
| <I/σ> (avg) | 7.05 (1.10) |
| B-factor (Wilson) (Å$^2$) | 39.05 |

TABLE 3-continued shows X-ray data statistics and refinement
statistics for a structure determined for
SM1B229 (a Fab variant of mAb 5133)
in the presence of GlcNac Structure Refinement

| | |
|---|---|
| Resolution (Å) | 41.10-2.50 (2.56-2.50) |
| No. reflections in refinement | 47751 (4651) |
| Number of atoms | 13353 |
| Number of solvent atoms | 331 |
| $Re_{cryst}$ (%) | 21.49 (31.17) |
| $R_{free}$ (%) | 28.40 (37.08) |
| RMSD bond lengths (Å) | 0.01 |
| RMSD bond angles (°) | 1.318 |
| Mean B factors (Å$^2$) | 41.61 |
| Ramachandran plot | |
| Favored (%) | 96.8 |
| Allowed (%) | 2.9 |
| Outliers (%) | 0.3 |

Results.

Figure 24A:
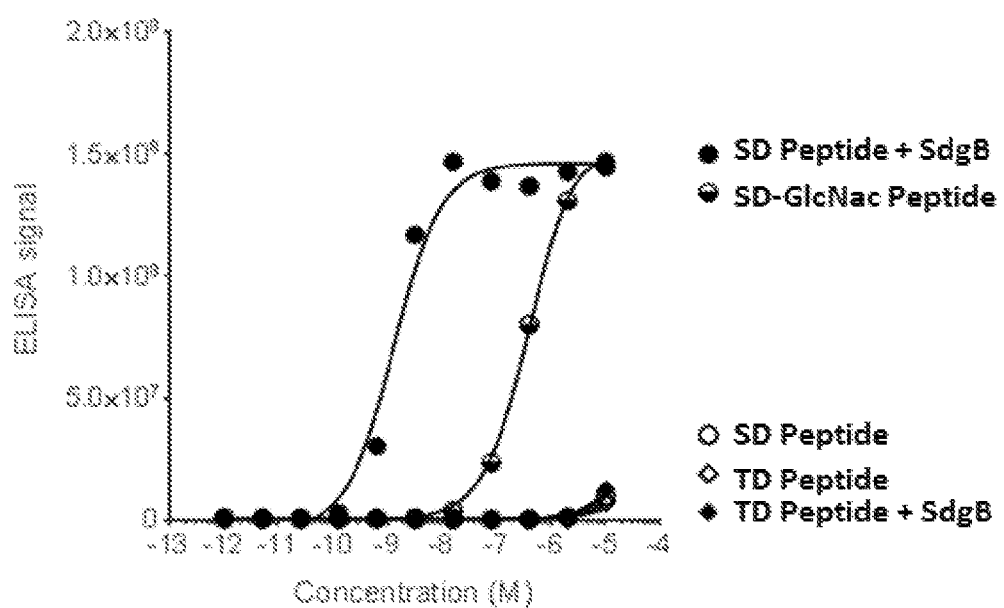
FIGS. 24A-24C define a further minimal epitope for mAb 5133 and characterize the interaction of mAB 5133 with N-acetyl-D-glucosamine as determined by x-ray crystallography.

To further define a minimal epitope for mAb 5133, a series of synthetic peptides with or without in vitro glycosylation with the SdgB glycosyltransferase were employed. As is shown in FIG. 24A, no mAb 5133 binding is apparent with the SD peptide in the absence of glycosylation. In contrast, potent binding is observed following in vitro modification with the SdgB glycosyltransferase in the presence of UDP-GlcNac. As expected, no binding of mAb 5133 is apparent with either the TD peptide with or without prior treatment with SdgB and no glycosylation of the TD peptide was apparent via MALDI analysis. These data substantiate the specificity of the SdgB glycosyltransferase in appending GlcNac specifically to the serine residues of SD repeat peptides or proteins. Finally, the chemical introduction of a single GlcNac moiety on the carboxyl-terminal Serine residue of the 'SD-GlcNac' peptide was observed to create a binding epitope for mAb 5133 with an apparent binding affinity approximately ~400-fold weaker than that observed with the SdgB-modified SD peptide.

Figure 24B:
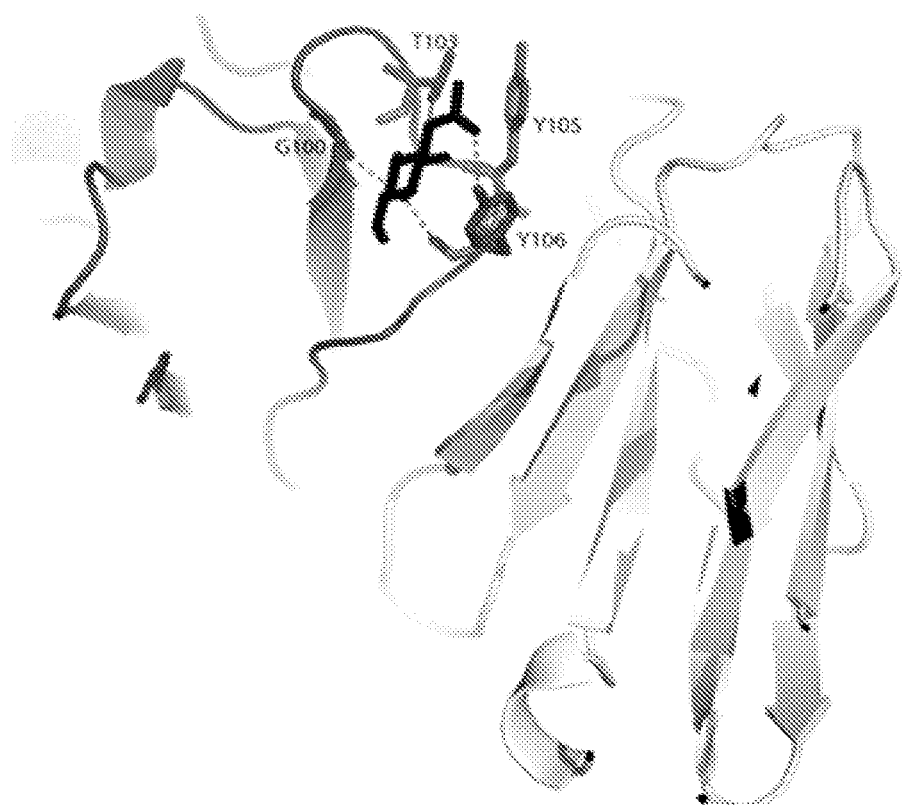
Figure 24C:
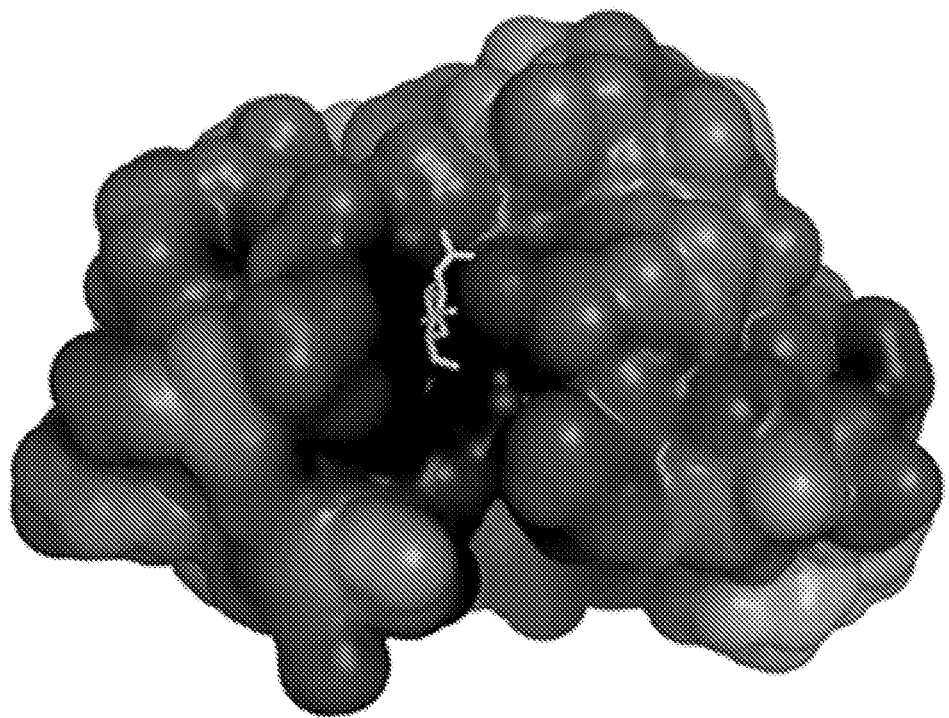

The X-ray crystal structure of SM1B229 (a Fab variant of mAb 5133) in complex with N-Acetylglucosamine (GlcNAc) was determined at 2.50 Å resolution. Table 3 shows the X-ray data statistics and refinement statistics for a structure determined for SM1B229 (a Fab variant of mAb 5133) in the presence of GlcNac. There are four molecules per asymmetric unit (heavy chain ID's: H, A, C, E; light chain ID's: L, B, D, F). GlcNAc was found only in two copies: HL and AB, where the GlcNAc molecule binds to chain H and chain A. The variable regions of HL and AB superimpose with rmsd=0.27 and GlcNAc is in the same orientation for both copies. Structural analysis was performed with copy AB. As is shown in FIG. 24B, GlcNAc is positioned in the binding pocket formed by residues R98-H109 of the H3-CDR (F). Binding to GlcNAc is mediated by hydrogen bonding interactions from side-chain hydroxyl groups of T103 and Y106 and main-chain hydrogen bonding from G100, Y105, and Y106. There is also a stacking interaction between Y106 and the glucopyranosyl ring of GlcNAc (FIG. 24B-24C). The light chain is not involved in the interaction.

GlcNAc modification of serine residues creates an antigen that is predicted to be highly polar and acidic. The electrostatic surface potential of SM1B229 reveals a basic pocket that is formed by CDR-H3, composed of the amino acids indicated in the variable heavy region sequence shown in FIG. 24C (see bold and underlined sequence). Tyr32(VH) and Tyr91(VL) line and complete the pocket. In addition to the identified binding site for GlcNAc, the surrounding basic CDR-H3 (Arg and/or His) residues that line the pocket likely interact with the acidic aspartate residue(s) of the SDR protein.

Summary.

The studies described herein further define a minimal binding epitope for mAb 5133 as a single GlcNac modified serine residue in the context of an SD repeat sequence. The structure of SM1B229 (a Fab variant of mAb 5133) in complex with GlcNAc reveals unique interactions with features of the GlcNac moiety. Finally, inspection of the antigen binding pocket reveals residues that are predicted to engage the acidic aspartate residues of the antigen and implies that multiple $Ser^{GlcNaC}Asp$ units may be accommodated.

Example 25: Characterization of Fibronectin Type III (FN3) Domains that Bind Alpha Hemolysin (Hla) of *Staphylococcus aureus*

Herein is described the characterization of fibronectin type III (FN3) domain variants which bind the alpha hemolysin (Hla) protein of *Staphylococcus aureus*.

Procedures.

Protein Reagents.

Test articles included in these studies included recombinant, purified polyhistidine-tagged versions of Luk967 (SEQ ID NO: 1097), Luk969 (SEQ ID NO: 1099), Luk982 (SEQ ID NO: 1112), Luk1012 (SEQ ID NO: 1142), Luk970 (SEQ ID NO: 1100) that were selected as Hla binders and the parental control FN3 binding domain protein TENCON parent (SEQ ID NO: 1241); all were purified from *E coli* using standard methods by nickel affinity chromatography. A poly-histidine tagged variant of a toxoid (H35L) form of Hla (Menzies et al., "Site-directed mutagenesis of the alpha-toxin gene of *Staphylococcus aureus*: role of histidines in toxin activity in vitro and in a murine model," *Infect. Immun.* 62:1843-47 (1994), which is hereby incorporated by reference in its entirety) was purified from *E. coli* by nickel affinity chromatography and corresponds to SED ID NO: 1086. For ELISA assays, Hla$^{H35L}$ was biotinylated in vitro using the SureLINK™ Chromophoric Biotin Labeling Kit (KPL, Inc.). Human serum albumin (HSA) conjugated with biotin (10-20 moles Biotin per mole of albumin) was purchased from Rockland Immunochemicals Inc. (Product #009-0633). A mouse monoclonal [8B7] specific to alpha-hemolysin was purchased from IBT Bioservices (Product #0210-001). Finally, an HRP-conjugated monoclonal antibody specific for the detection of poly-histidine sequences was purchased from R&D Systems (Product #MAB050H).

ELISA assays. The relative binding of the FN3 domain proteins and control test articles to purified, recombinant Hla$^{H35L}$ protein and HSA was determined by ELISA. Briefly, 100l of a 5 µg/mL solution of streptavidin (in PBS) was added per well of a 96 well White Maxisorp plate (Nunc-cat#436110) and incubated overnight at 4° C. Wells were then washed 3× with TBST (50 mM Tris.HCl, pH 7.4, 150 mM NaCl, 0.1% Tween 20) and blocked with 300 µL/well with StartingBlock T20 (Pierce cat#37543) and incubated 45-60 minutes at room temperature (RT). The plate was then washed 3 times with TBST and 0.2 µg of biotinylated versions of the target antigens (HSA or Hla$^{H35L}$ in 100 µL) were added to each test well and the plate incubated 45-60 minutes at RT with gentle shaking. The plate was then washed 3 times with TBST. Test articles were diluted to 1 μM in StartingBlock T20 and 100 μL added to test wells and the plate incubated 45-60 minutes at RT with gentle shaking. The plate was then washed 3 times with TBST. For detection of bound FN3 domain test articles, 100 μL/well of a polyclonal anti-FN3-HRP antibody diluted 1:5000 in Starting block T20 was added and the plate incubated for 45-60 min at RT with gentle shaking. The plate was then washed 3 times with TBST. For detection of bound test articles, 100 μL/well of a peroxidase-conjugated, F(ab')2 fragment of a goat anti-mouse IgG, FC-γ fragment specific antibody (Jackson Immuno Research product 115-036-071) diluted 1:5000 in Starting block T20 was added and the plate incubated for 45-60 min at RT with gentle shaking. The plate was then washed 3 times with TBST. To detect bound F(ab')2 fragment of the goat anti-mouse antibody, 100 μL/well of the POD Chemiluminescence substrate (Roche-cat#11582950001) was added immediately prior to reading plates and the plates read using an Envision reader within 15 minutes of the substrate addition.

Results.

Figure 25:
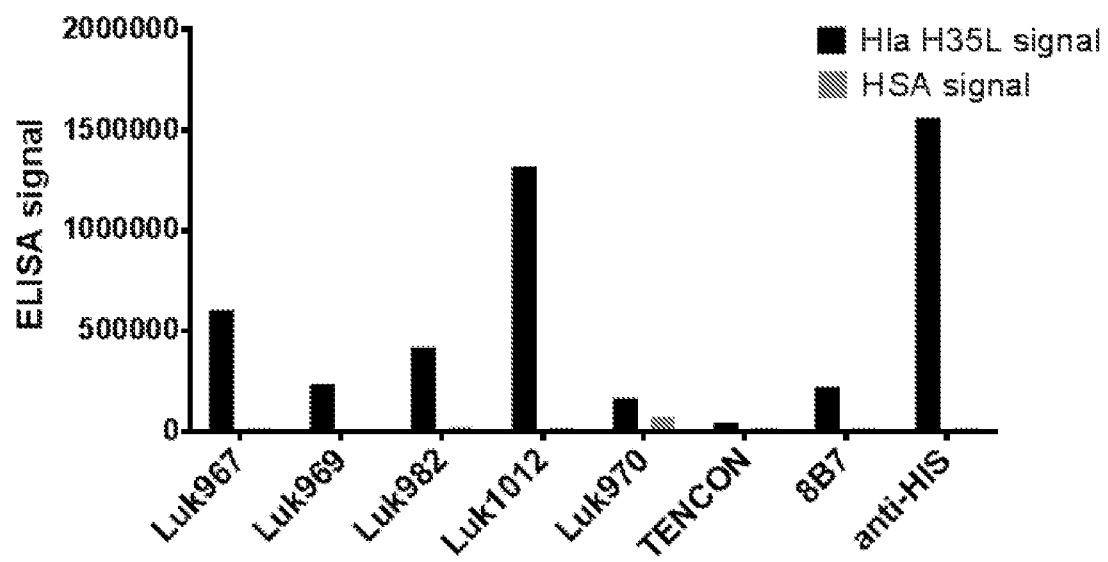
FIG. 25 shows the binding of fibronectin type III (FN3) domain proteins and controls to *S. aureus* alpha hemolysin and human serum albumin as determined in an ELISA format assay.

FIG. 25A shows the relative ELISA signal detected for each of the test articles for both HSA and the Hla$^{H35L}$ proteins. As expected, the FN3 domain proteins exhibit a range of apparent potency in binding the Hla$^{H35L}$ protein but show minimal if any detectable binding to HSA. Specific binding of the '8B7' mouse monoclonal antibody to the Hla$^{H35L}$ protein is also apparent although the signal is weaker than some of the FN3 domain proteins under the conditions tested. Finally, as a control, detection of the plate-bound Hla$^{H35L}$ protein is shown through detection using the anti-His monoclonal antibody.

Summary.

These data indicate that FN3 domain variants can be identified that exhibit specific binding to the *S. aureus* Hla (alpha hemolysin) protein. Based on the past characterization of related FN3 domain variants that selectively bind other toxin proteins of *S. aureus* (see WO2015089073 to Torres, which is hereby incorporated by reference in its entirety), it is anticipated that a subset of the FN3 domain variants described herein will neutralize the cytolytic activity of Hla.

Example 26: Characterization of Stem Domain Mutant Variants of LukAB that Retain the Neutralization Epitope of the FN3 Domain Protein Luk17

The so-called stem domains of the bi-component leukocidins of *S. aureus* are a key structural element necessary for the formation of the active oligomeric, pore forms of the toxins that pierce the host cell membrane and trigger cell death via osmotic lysis. Examination of the amino acid sequences of the *S. aureus* LukE and LukD sequences previously revealed glycine-rich motifs that localize to the stem domains of the monomer subunits of each leukocidin and leukocidin variants bearing in-frame deletions in these sequences and those of related leukocidins were found to be both inactive as toxins and exhibited a dominant-negative phenotype (Reyes-Robles et al., "Exploiting dominant-negative toxins to combat *Staphylococcus aureus* pathogenesis," *EMBO Reports* 17(3): 428-40 (2016), which is hereby incorporated by reference in its entirety). Determination of a heterodimeric structure of LukAB in a pre-pore conformation (see EXAMPLE 21) led to the design of more extensive stem loop deletion variants and their characterization is described herein. Critically it is demonstrated herein that such mutants retain the LukAB neutralization epitope recognized by the Luk17 FN3 domain protein (see EXAMPLES 21 and 22) and therein have potential utility as protein antigens in vaccine compositions.

Procedures.

Proteins & Reagents.

Variants of LukA and LukB that bear in-frame deletions+/− insertions in the stem domain were designed and are described in Table 4. In each case, these stem mutants were created in the context of a toxoid variant of the LukAB protein (LukA E323A) (DuMont et al., "Identification of a Crucial Residue Required for *Staphylococcus aureus* LukAB Cytotoxicity and Receptor Recognition," *Infect Immun.* 82(3):1268-76 (2014), which is hereby incorporated by reference in its entirety) and were further engineered to bear poly-histidine sequences at the amino-terminus of the LukA subunit. Recombinant LukAB stem mutant proteins were purified from *E. coli* cells co-expressing each subunit and purified by nickel affinity chromatography as soluble heterodimers from *E. coli*. For these studies, variants of the anti-LukAB Luk17 FN3 domain protein and the parental TENCON control FN3 domain protein were engineered that bear carboxyl-terminal extensions including both poly-histidine and streptavidin binding sequences and correspond to SEQ ID NOs: 1153 and 1152, respectively, and are herein referred to as Luk17-His-SA and TENCON-His-SA. Both proteins were purified by nickel affinity chromatography from an *E. coli* strain expressing biotin ligase.

TABLE 4

LukA and LukB Stem Domain Mutants

| SEQ ID NO: | Subunit | Stem Deletion* | Insertion | Construct Name |
|---|---|---|---|---|
| 1149 | LukA | $Ser^{144}$-$Gly^{149}$ | None | $LukAB^{mut1}$ |
| 1150 | LukB | $Gly^{122}$-$Ser^{126}$ | None | |
| 1149 | LukA | $Ser^{144}$-$Gly^{149}$ | None | $LukAB^{mut2}$ |
| 1151 | LukB | $Gly^{130}$-$Gly^{134}$ | None | |
| 1022 | LukA | $Ser^{135}$-$Gln^{174}$ | $(\text{-SerGlyGly})_2$ | $LukAB^{mut3}$ |
| 1029 | LukB | $Ser^{110}$-$Pro^{151}$ | $(\text{-SerGlyGly})_2$ | |

*Amino acid numbering as per PDB file 4TW1

Luk17 FN3 Domain Binding Studies.

Binding of the biotinylated variants of the Luk17-His-SA and TENCON-His-SA FN3 domain proteins to LukAB and the LukAB stem mutant variants was determined by Bio-Layer Interferometry (BLI) using an $Octet^{RED}$ 384 instrument (forteBIO Inc.). Briefly, the Luk17-His-SA and TENCON-His-SA proteins were loaded onto Dip and Read™ Streptavidin (SA) Biosensor pins at a 10 μg/mL concentration in PBS pH7.2 for 5 minutes. A baseline was then set by washing with phosphate buffered saline (PBS, pH 7.2) for 1 minute. Thereafter, either LukAB or stem domain LukAB variants were loaded at a 10 ug/mL concentration in PBS (pH7.2) and association measured over a period of 5 minutes. The baseline was then reset by washing with phosphate buffered saline (PBS, pH 7.2) for 1 minute.

Results.

FIG. 26A shows the association between the Luk17-His-SA and TENCON-His-SA proteins for the LukAB toxoid protein (LukA E323A). As expected, in contrast to Luk17-His-SA, no binding is detected with the parental control FN3 domain protein TENCON-His-SA. FIGS. 26B-26C show the association between the Luk17-His-SA and TENCON-His-SA proteins for the $LukAB^{mut1}$ and $LukAB^{mut2}$ stem domain variants (DuMont et al., *Infect Immun.* 82(3): 1268-76 (2014), which is hereby incorporated by reference in its entirety) that bear targeted in-frame deletions of short glycine rich sequences in the stem domains of both LukA and LukB (Table 4). In each case, binding of the Luk17-His-SA protein is observed with no apparent binding of the TEN-CON-His-SA protein indicating that the LukAB neutralization epitope for the Luk17 FN3 protein is preserved in the LukAB$^{mut1}$ and LukAB$^{mut2}$ stem domain variants.

Figure 26A:
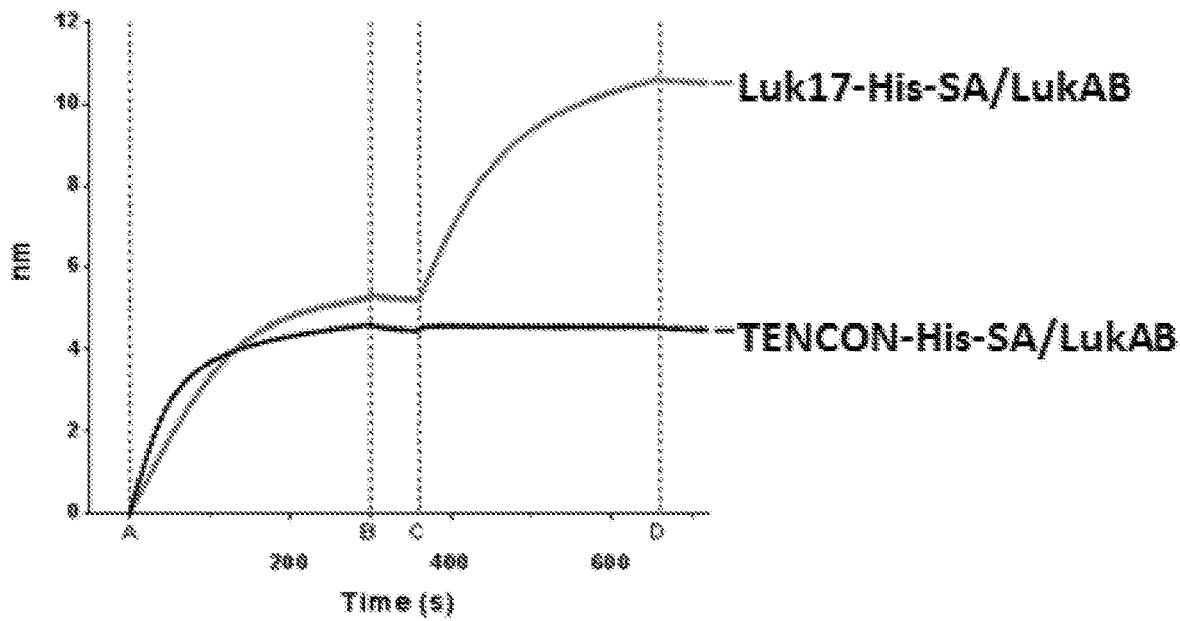
FIGS. 26A-26D depict the characterization of stem domain mutant variants of LukAB that retain the neutralization epitope of the FN3 domain protein Luk17.
Figure 26B:
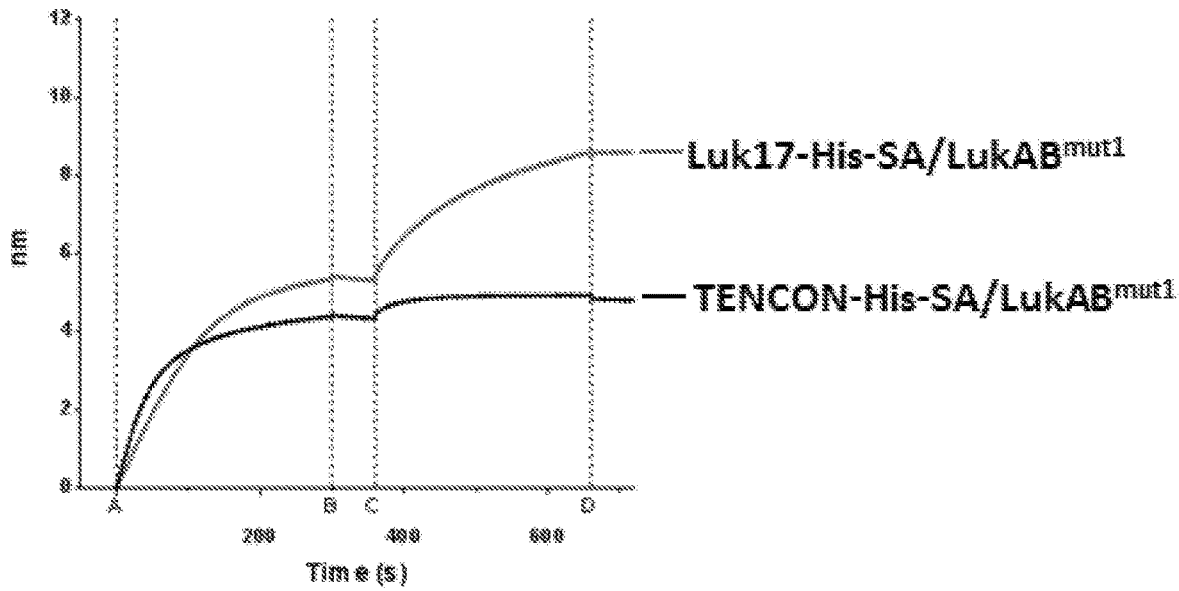
Figure 26C:
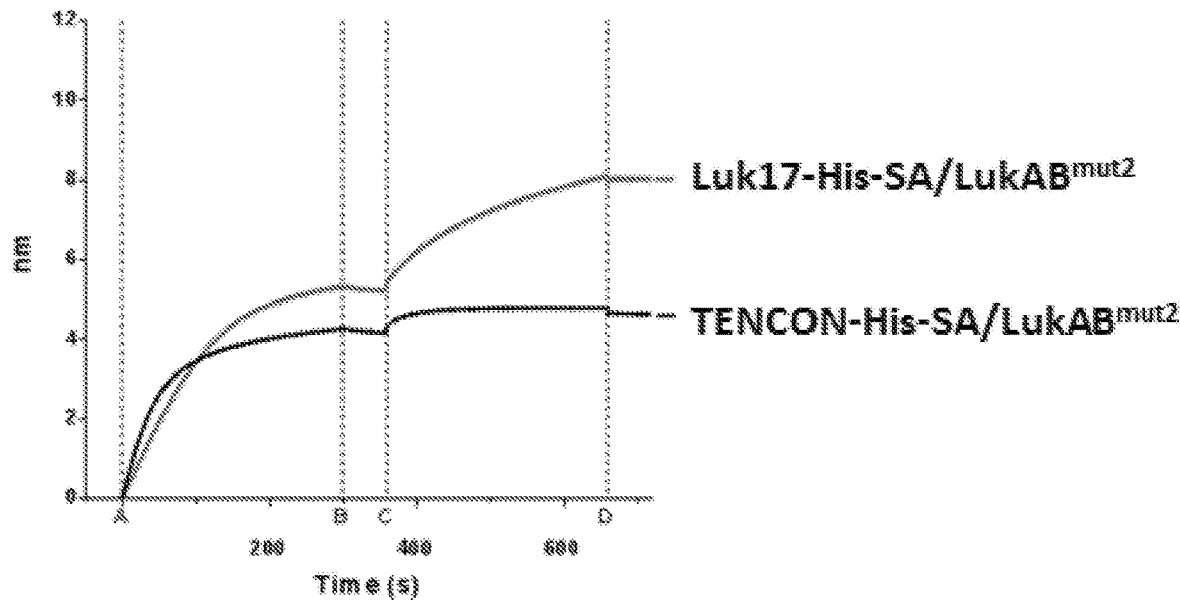
Figure 26D:
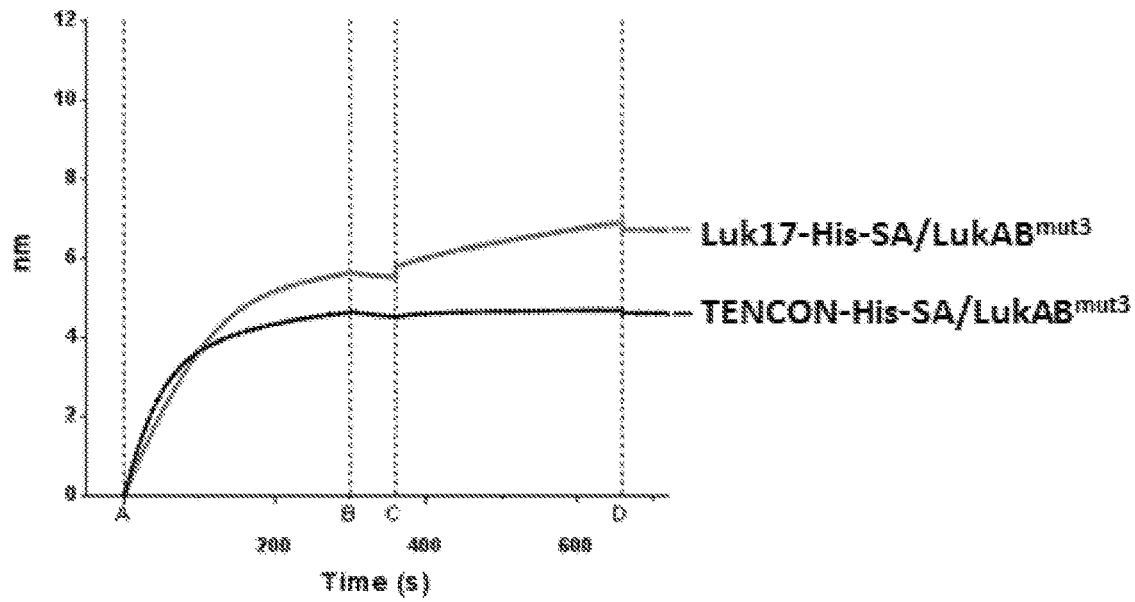

Similarly, FIG. 26D shows the association between the Luk17-His-SA and TENCON-His-SA proteins for the LukAB$^{mut3}$ variant in which entire stem domains of LukA and LukB have been replaced with a short, flexible peptide insertion sequence, i.e., (SerGlyGly)$_2$. This stem mutant variant and related variants (see SEQ IDs 1023, 1024, 1025, 1030, 1031 and 1032) were designed through analysis of the heterodimeric structure of LukAB in a pre-pore conformation (see EXAMPLE 21). Again, binding of the Luk17-His-SA protein is observed with no apparent binding of the TENCON-His-SA protein indicating that the LukAB neutralization epitope for the Luk17 FN3 protein is preserved in the LukAB$^{mut3}$ stem domain variants.

Summary.

The studies described herein establish the potential of structure-based, designed variants of the LukAB leukotoxin as vaccine antigens. Specifically, LukAB variants that possess in-frame deletions in the loop sequences important for the formation of the active oligomeric pore forms necessary for localization in or at the host cell membrane retain a LukAB neutralization epitope for the Luk17 FN3 protein. Use of such LukAB variants as protein antigens in vaccine compositions is therein expected to elicit the generation antibodies that similarly bind and neutralize the cytolytic activity of LukAB.

Example 27: Anti-LukE FN3 Domain Proteins with Extended Serum Exposure Protect Mice from Lethal Doses of Leukotoxin LukED FN3 domain proteins have molecular weights in the 10-11 kDa range and are rapidly cleared from the bloodstream via renal clearance as they are significantly below the glomerular filtration molecular weight cut-off of ~70 kDa. Hence, the measured half-lives of FN3 domain proteins in serum are short (<1 hour). Herein, is described the characterization of designed fusion proteins wherein the parental FN3 domain proteins are genetically fused with partner protein domains that confer the property of extending the serum exposure of the fusion proteins. In one example, the anti-LukE FN3 domain protein Luk26 is fused with an FN3 domain protein that binds serum albumin. In a second example, the anti-LukE FN3 domain protein Luk26 is fused with an FN3 domain protein that binds transferrin. In a third example, the anti-LukE FN3 domain protein Luk26 is fused with a serum albumin binding domain protein. For each example, equivalent fusion proteins were also made to the parental FN3 domain protein, TENCON. In all cases, four copies of a G$_4$S linker were employed at the fusion juncture and polyhistidine sequences were added at the carboxyl terminus to facilitate purification. Serum albumin and transferrin are two of the most highly abundant proteins in the blood and it was assumed that fusion of FN3 domain proteins to high affinity binding domains for each of these serum proteins would result in extension of the residence time (and therein exposure) in the serum of the fusion proteins when compared to the parental FN3 domain proteins.

Procedures.

Test Articles.

Table 5 provides details of the test articles employed in the studies described herein. In all cases, proteins were purified from *E. coli* by nickel affinity chromatography using standard methods and endotoxin contaminants removed using a commercial kit (Acrodisc® Units with Mustang® E Membrane, Pall Corp.).

TABLE 5

Test Articles Deployed.

| SEQ ID NO: | Description | Abbreviation | MW (Da) |
|---|---|---|---|
| 1177 | Parental FN3 domain protein | TENCON | 10,670 |
| 1077 | Anti-LukE FN3 domain protein | LukE26 | 10,660 |
| 1171 | Anti-serum albumin FN3 domain-TENCON fusion protein | SAFN3-TENCON | 21,876 |
| 1172 | Serum albumin binding domain-TENCON fusion protein | SABD-TENCON | 17,842 |
| 1173 | Anti-transferrin FN3 domain-TENCON fusion protein | TFFN3-TENCON | 21,636 |
| 1174 | Anti-serum albumin FN3 domain-LukE26 fusion protein | SAFN3-LukE26 | 21,866 |
| 1175 | Serum albumin binding domain-LukE26 fusion protein | SABD-LukE26 | 17,832 |
| 1176 | Anti-transferrin FN3 domain-LukE26 fusion protein | TFFN3-LukE26 | 21,626 |

Detection of Test Articles in Serum.

Test articles were formulated in phosphate buffered saline (pH 7.2) and 500 μs of each (in a volume of 100 μL) was administered to female, 5-6 week old Swiss Webster ND4 mice via the retro-orbital (RO) route with a group of three animals employed per test article. 50 μL of blood was collected from each animal two hours post-dosing via the tail and +24 hour blood samples obtained via terminal cardiac puncture. At each time-point, the blood was collected into serum separator tubes, allowed to sit for at least 30 minutes, and then centrifuged for 5 minutes at 4500 rpm. Serum samples were then collected and frozen at −80° C. for subsequent analysis. For analysis by western blot, an aliquot of each serum sample was thawed on ice and the serum pooled for each test article for the +2 and +24 hour samples by combination of sera from each of the three animals per group. Each sample was diluted 1:10 in PBS and 2 μL loaded per lane on an SDS-PAGE gel. Separated proteins were transferred to a nitrocellulose membrane and the test articles detected by use of a fluorescently conjugated (IRDye® 680LT Infrared Dye (LICOR)) preparation of a rabbit monoclonal antibody specific for the framework of the TENCON FN3 binding domain protein and that is cross-reactive with the Luk26 FN3 domain protein.

LukED Neutralization Studies.

The FN3 domain test articles, starting at 7.2 μM, were titrated against a constant dose (LD$_{90}$) of purified LukED on freshly isolated human PMNs. Freshly isolated human PMNs (hPMNs, 200,000) from healthy donors were intoxicated for 1 hour in a final volume of 100 μl in RPMI+10 mM HEPES+0.1% human serum albumin. Following a 1 hour intoxication in a 37° C. CO$_2$ incubator, 25 μl of supernatant was carefully transferred to a new plate after spinning the plate down at 1500 RPM for 10 mins. Cell Titer reagent (Promega) was added to the remaining cells and incubated for 1.5 hours. The 25 μl of supernatant were mixed with equal amounts of CytoTox-ONE™ Assay reagent (Promega) that rapidly measures the amount of released of lactate dehydrogenase (LDH) from cells with a damaged membrane. LDH released into the culture medium was measured with a 10-minute coupled enzymatic assay that results in the conversion of resazurin into a fluorescent resorufin product.

For these ex vivo neutralization experiments, purified LukED was used at a final concentration of 72.5 nM (2.5 µg/mL per subunit).

LukED Intoxication Studies.

5 week old ND4 mice were treated with 130 µl of a 138.5 µM normalized stock of each test article via intravenous (IV) retroorbital administration in groups of 3 mice. After an hour, mice were intoxicated with purified toxin at 6 µg per subunit of LukED (lethal dose) IV and then monitored for signs of imminent death: labored breathing, ruffled fur, and paralysis/lack of movement. Mice that survived the first intoxication were then given a second lethal dose of LukED IV approximately 4.5 hours after the first lethal dose of LukED (for a total of 24 µg in 5 hrs). Mice were monitored for the same signs of imminent death as previously described. In a further study, mice were treated with SABD-LukE26 at doses corresponding to a 1×, 10× and 100× molar ratio to the administered LukED toxin and then challenged 5, 24 and 48 hours post-dosing.

Results.

Figure 27A:
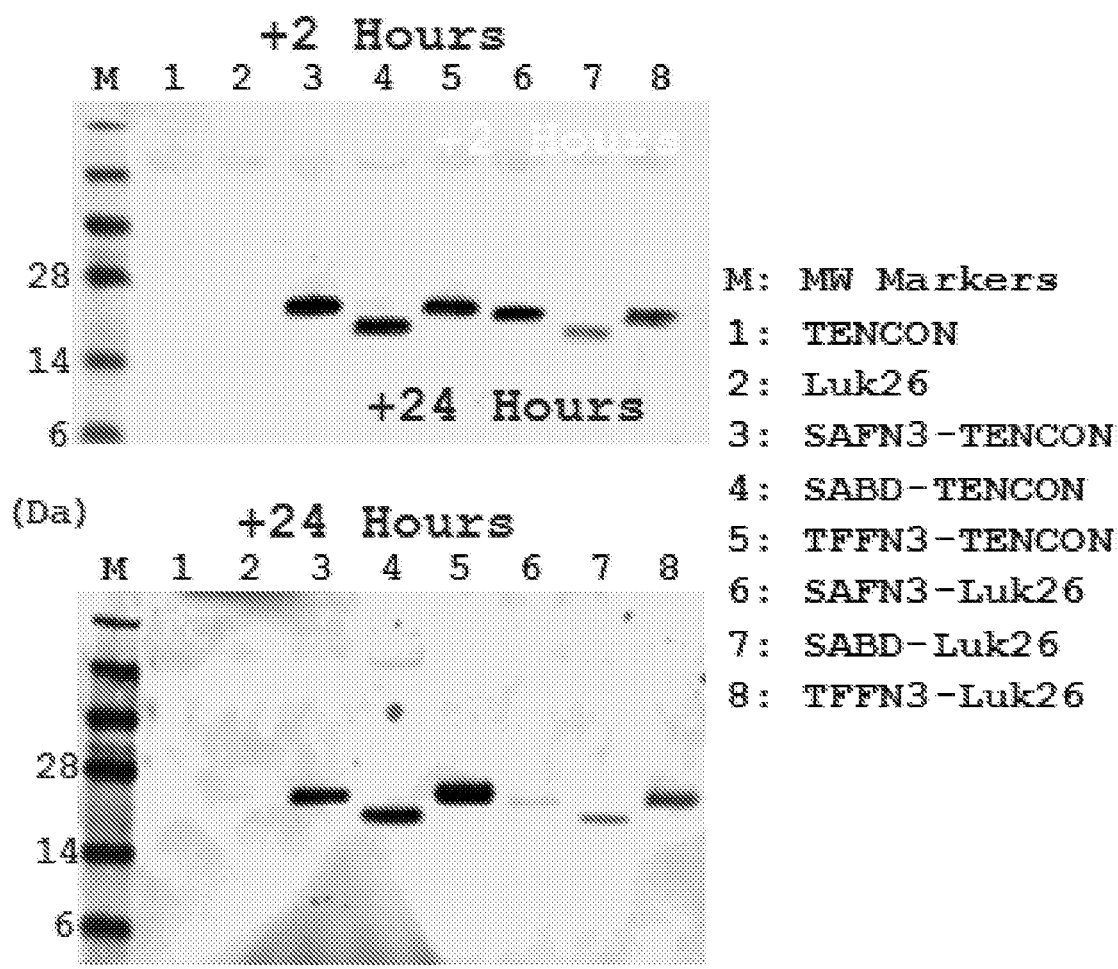
FIGS. 27A-27I demonstrate that anti-LukE FN3 domain proteins with extended serum exposure protect mice from lethal doses of leukotoxin LukED.

FIG. 27A shows the analysis of serum samples from mice dosed with each of the test articles. As expected, neither the TENCON (Lanes 1) nor the LukE26 FN3 binding domain (Lanes 2) proteins were detected either +2 hours or +24 hours post administration. In contrast, each of the FN3 domain fusion proteins was detected both +2 hours and +24 hours post administration with the LukE26 fusion proteins exhibiting somewhat lower overall levels +24 hours post administration. These data indicate that fusion of either the TENCON or LukE26 FN3 binding domain proteins to either of the three protein fusion partners results in the expected increased residence time (and therein exposure) in the blood.

Figure 27B:
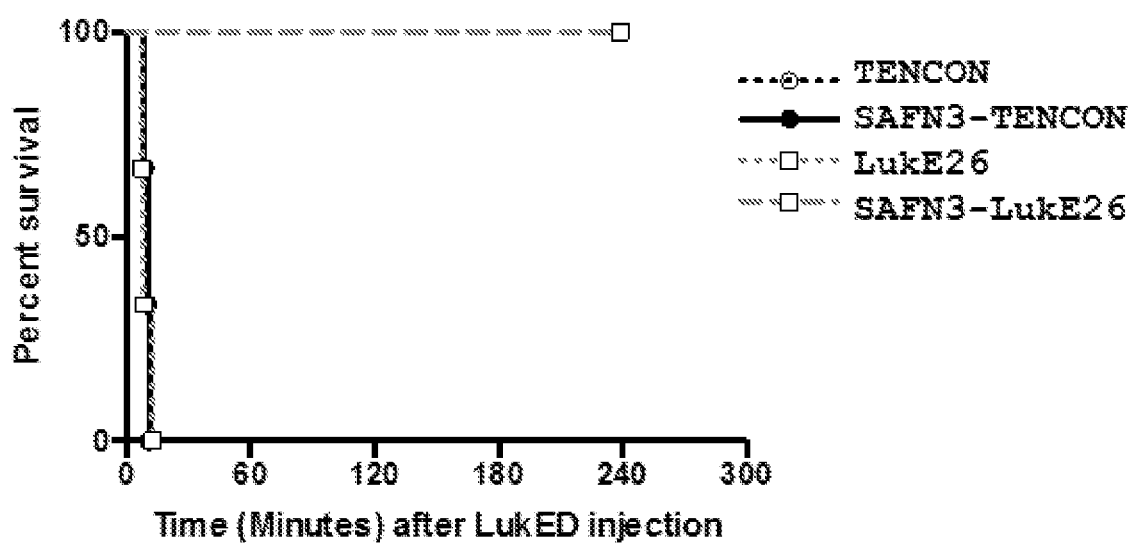
Figure 27C:
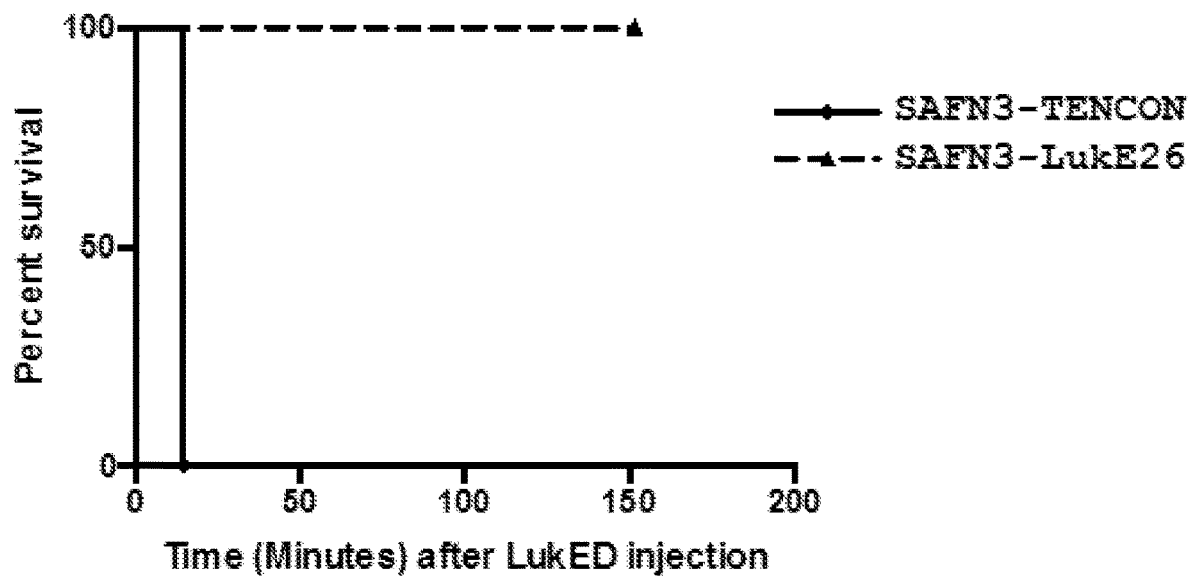

FIG. 27B shows the relative protection of mice following administration of a lethal dose of the LukED leukocidin one hour post dosing of SAFN3-TENCON, SAFN3-LukE26 and parental FN3 domain proteins. As expected based on the test article composition and serum exposure, only protection was observed with the SAFN3-LukE26 protein. Mice protected by administration of the SAFN3-LukE26 protein were then re-challenged approximately 4.5 hours after the first LukED challenge (for a total of 24 µg in 5 hrs) and FIG. 27C shows the relative protection of mice observed. Again, 100% protection was observed in the SAFN3-LukE26 µgroup.

Figure 27D:
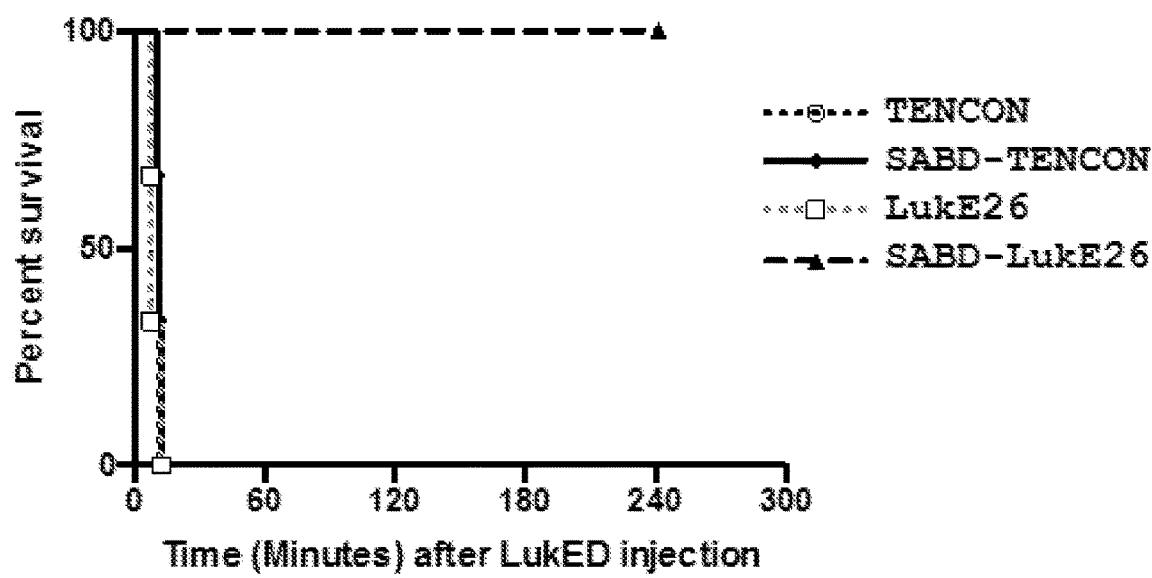
Figure 27E:
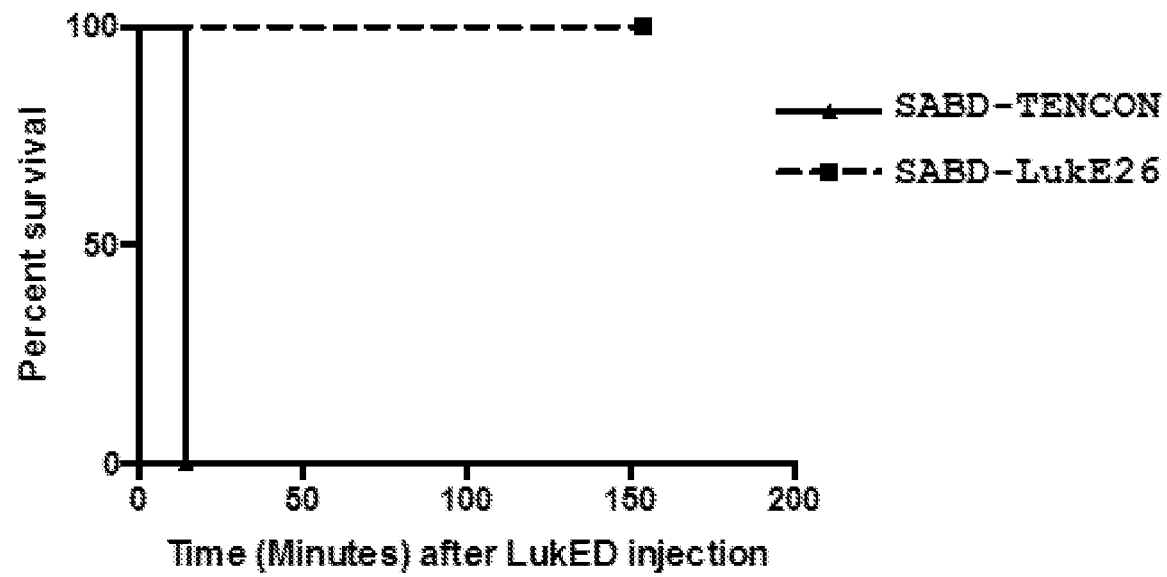

FIG. 27D shows the relative protection of mice following administration of a lethal dose of the LukED leukocidin one hour post dosing of SABD-TENCON, SABD-LukE26 and parental FN3 domain proteins. As expected based on the test article composition and serum exposure, only protection was observed with the SABD-LukE26 protein. Mice protected by administration of the SABD-LukE26 protein were then re-challenged approximately 4.5 hours after the first LukED challenge (for a total of 24 µg in 5 hrs) and FIG. 27E shows the relative protection of mice observed. Again, 100% protection was observed in the SABD-LukE26 µgroup.

Figure 27F:
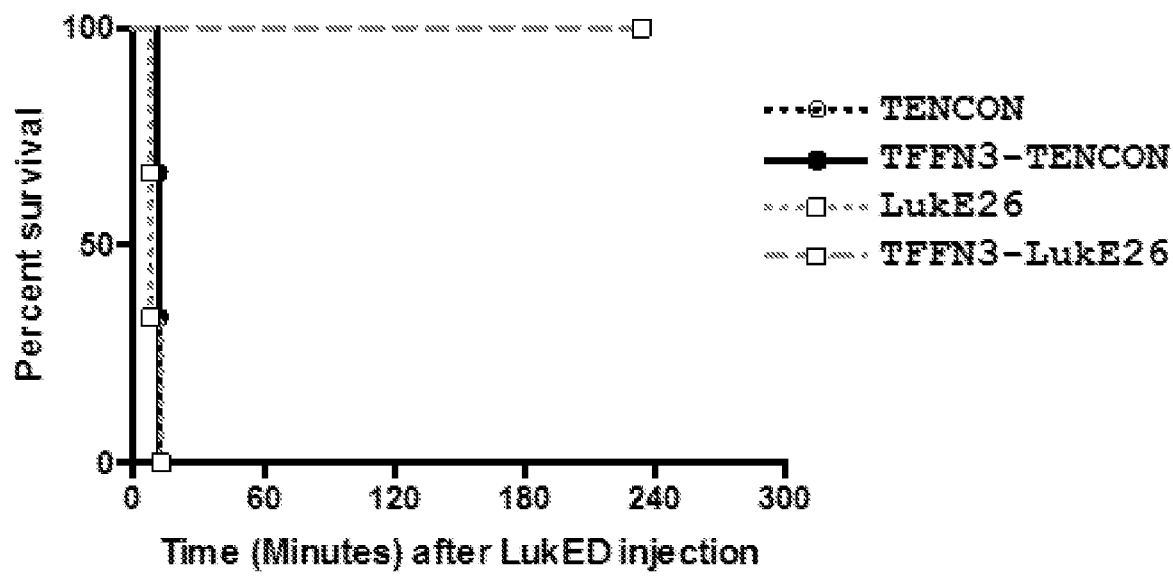

FIG. 27F shows the relative protection of mice following administration of a lethal dose of the LukED leukocidin one hour post dosing of TFFN3-LukE26, TFFN3-TENCON and parental FN3 domain proteins. As expected based on the test article composition and serum exposure, only protection is observed with the TFFN3-LukE26 protein.

Figure 27G:
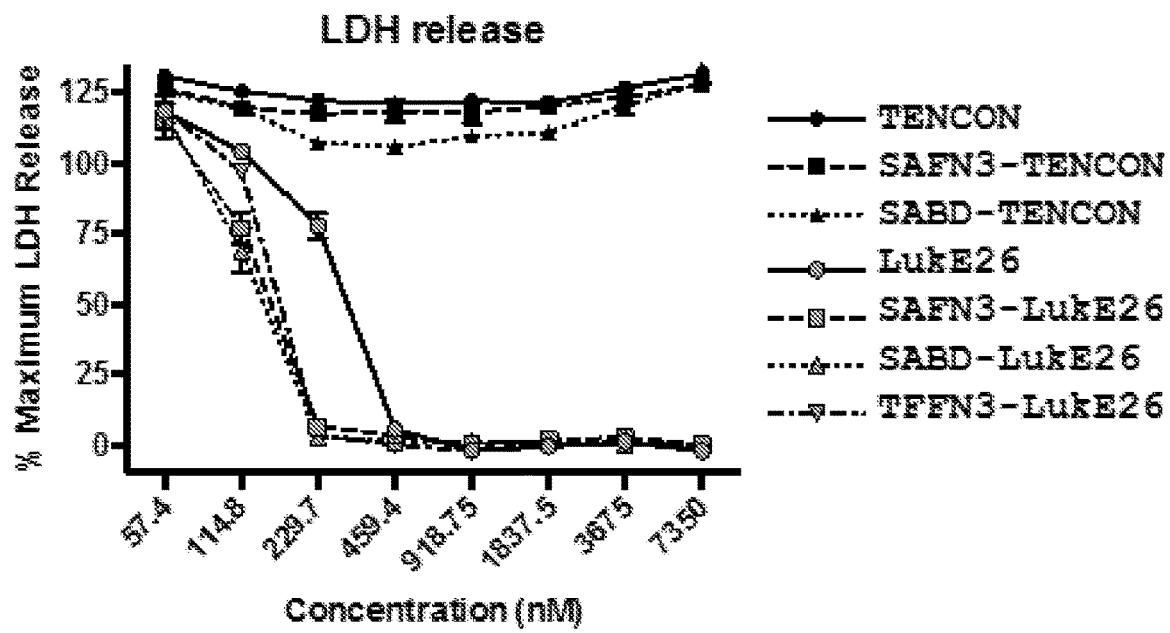
Figure 27H:
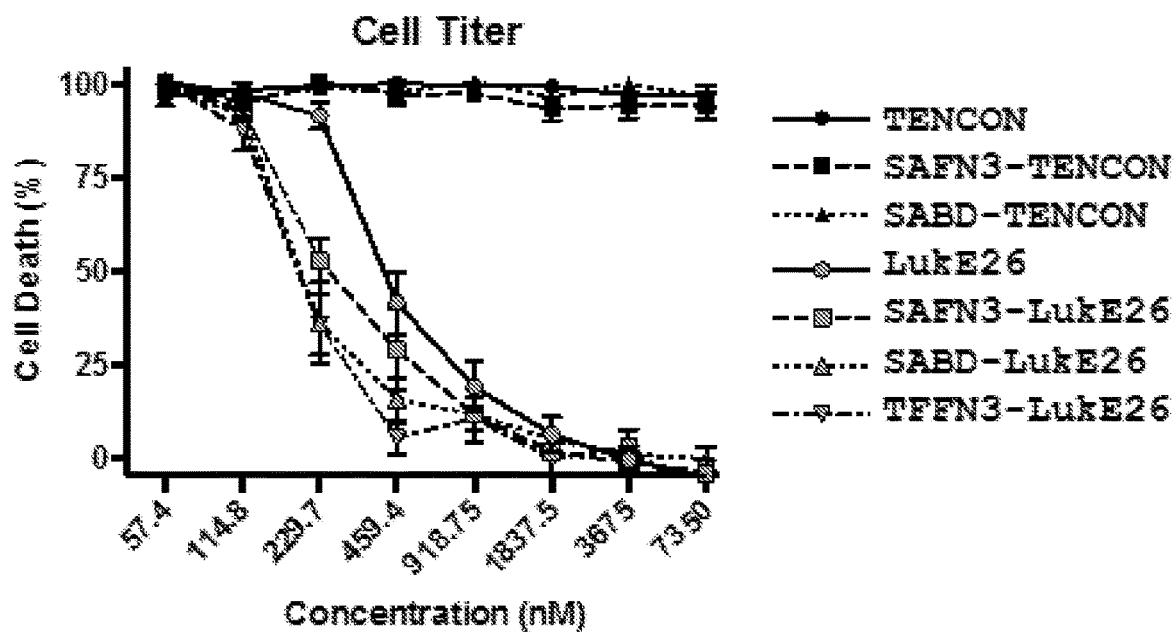

FIGS. 27G-27H shows the extent of protection of LukED-mediated hPMN cytolysis observed in the presence of the test articles as determined by LDH release (FIG. 27G) and ATP quantitation as a measure of viable cells (FIG. 27H). As expected, only protection from of LukED-mediated hPMN cytolysis is observed with the four LukE26 bearing test articles.

Figure 27I:
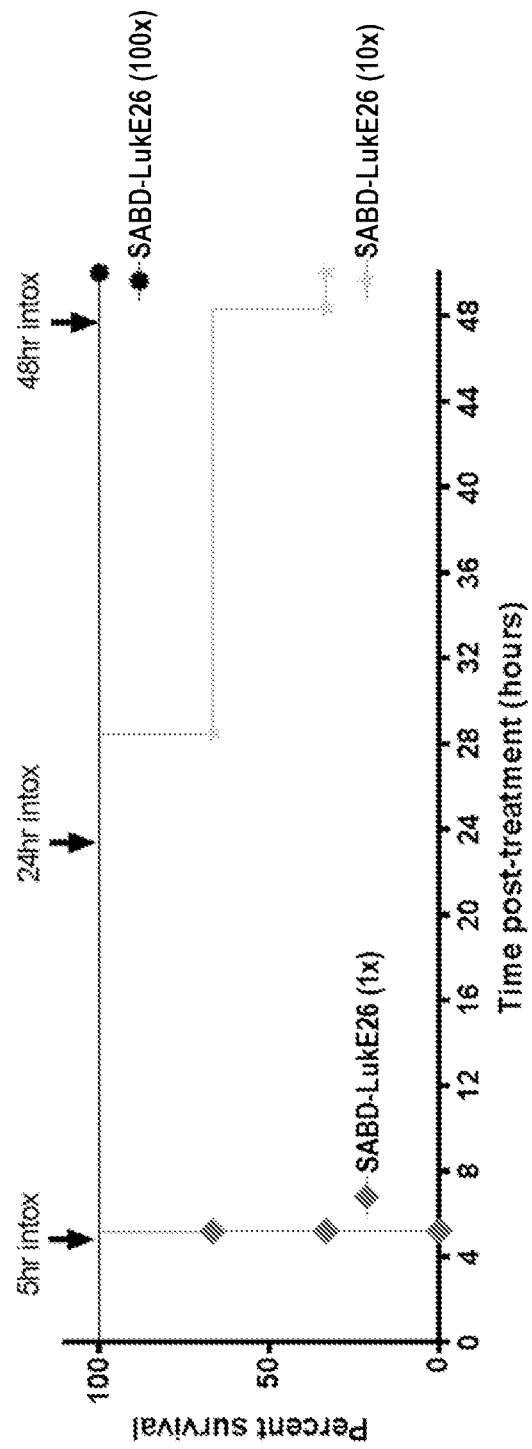

Finally, FIG. 27I shows the extent of protection of mice following administration of sequential lethal doses of the LukED leukocidin 5, 24 and 48 hours post dosing of SABD-Luk26 at a 1×, 10× and 100× molar ratio of SABD-Luk26 over LukED. In this study, no protection is observed on challenge with LukED 5-hours post-dosing at a 1:1 molar ratio of SABD-Luk26 and LukED. In contrast, 100% protection is observed at both 5- and 24-hours post-dosing at 10:1 and 100:1 molar ratios of SABD-Luk26:LukED and for the 100:1 dose, 100% protection is observed to extend beyond 48 hours.

Summary.

The studies described herein establish that FN3 domain proteins that bind LukE and neutralize the cytolytic activity of LukED ex vivo are able to protect mice from lethal intoxication mediated by LukED toxin if they are fused to protein domains that bind serum proteins such as to extend their serum residence time and therein exposure. In the context of the design and development of protein biologics that neutralize the cytolytic activity of bacterial toxins, a number of fusion partners can be envisaged for toxin-targeting FN3 domain proteins that should extend serum residence time and exposure including appendage to immunoglobulins via the light and/or heavy chain sequences as exemplified elsewhere in this application.

TABLE 6

Nucleic Acid and Amino Acid Sequences of the Disclosure

| SEQ ID NO: | Type | Species | Description | Sequence |
|---|---|---|---|---|
| 1 | PRT | Artificial | Tencon-25 | LPAPKNLVVSEVTEDSARLSWTAPDAAFDSFLI QYQESEKVGEAIVLTVPGSERSYDLTGLKPGTE YTVSIYGVKGGHRSNPLSAIFTT |
| 2 | PRT | Artificial | Linker | GGGGSGGGGSGGGGSGGGGS |
| 3 | PRT | Artificial | Tencon BC loop | TAPDAA |
| 4 | PRT | Artificial | Tencon FG loop | KGGHRSN |
| 5 | DNA | Artificial | POP2222 | CGGCGGTTAGAACGCGGCTAC |
| 6 | DNA | Artificial | POP2250 | CGGCGGTTAGAACGCGGCTACAATTAATAC |
| 7 | DNA | Artificial | DidLigRev | CATGATTACGCCAAGCTCAGAA |

TABLE 6-continued

Nucleic Acid and Amino Acid Sequences of the Disclosure

| SEQ ID NO: | Type | Species | Description | Sequence |
|---|---|---|---|---|
| 8 | DNA | Artificial | MDD40 | AGCCGCCGCCACCGGTTAATGGTGATGGTG ATGGTGACCACCGGTGGTGAAGATCGCAGA CAG |
| 9 | DNA | Artificial | MDD62 | AAGAAGGAGAACCGGTATGCTGCCGGCGCC GAAAAACCTGGTTGTTTCTCGTGTTACC |
| 10 | PRT | S. aureus | LukA | HHHHHHNSAHKDSQDQNKKEHVDKSQQKD KRNVTNKDKNSTAPDDIGKNGKITKRTETVY DEKTNILQNLQFDFIDDPTYDKNVLLVKKQGS IHSNLKFESHKEEKNSNWLKYPSEYHVDFQV KRNRKTEILDQLPKNKISTAKVDSTFSYSSGG KFDSTKGIGRTSSNSYSKTISYNQQNYDTIASG KNNNWHVHWSVIANDLKYGGEVKNRNDELL FYRNTRIATVENPELSFASKYRYPALVRSGFN PEFLTYLSNEKSNEKTQFEVTYTRNQDILKNR PGIHYAPPILEKNKDGQRLIVTYEVDWKNKTV KVVDKYSDDNKPYKAG |
| 11 | PRT | S. aureus | LukB | KINSEIKQVSEKNLDGDTKMYTRTATTSDSQK NITQSLQFNFLTEPNYDKETVFIKAKGTIGSGL RILDPNGYWNSTLRWPGSYSVSIQNVDDNNN TNVTDFAPKNQDESREVKYTYGYKTGGDFSI NRGGLTGNITKESNYSETISYQQPSYRTLLDQS TSHKGVGWKVEAHLINNMGHDHTRQLTNDS DNRTKSEIFSLTRNGNLWAKDNFTPKDKMPV TVSEGFNPEFLAVMSHDKKDKGKSQFVVHYK RSMDEFKIDWNRHGFWGYWSGENHVDKKEE KLSALYEVDWKTHNVKFVKVLNDNEKK |
| 12 | PRT | S. aureus | LukD | MGSSHHHHHHSSGLVPAGSHMLAQHITPVSE KKVDDKITLYKTTATSDNDKLNISQILTFNFIK DKSYDKDTLVLKAAGNINSGYKKPNPKDYN YSQFYWGGKYNVSVSSESNDAVNVVDYAPK NQNEEFQVQQTLGYSYGGDINISNGLSGGLN GSKSFSETINYKQESYRTTIDRKTNHKSIGWG VEAHKIMNNGWGPYGRDSYDPTYGNELFLG GRQSSSNAGQNFLPTHQMPLLARGNFNPEFIS VLSHKQNDTKKSKIKVTYQREMDRYTNQWN RLHWVGNNYKNQNTVTFTSTYEVDWQNHTV KLIGTDSKETNPGV |
| 13 | PRT | S. aureus | LukE | MGSSHHHHHHSSGLVPAGSHMLNTNIENIGD GAEVIKRTEDVSSKKWGVTQNVQFDFVKDK KYNKDALIVKMQGFINSRTSFSDVKGSGYELT KRMIWPFQYNIGLTTKDPNVSLINYLPKNKIE TTDVGQTLGYNIGGNFQSAPSIGGNGSFNYSK TISYTQKSYVSEVDKQNSKSVKWGVKANEFV TPDGKKSAHDRYLFVQSPNGPTGSAREYFAP DNQLPPLVQSGFNPSFITTLSHEKGSSDTSEFEI SYGRNLDITYATLFPRTGIYAERKHNAFVNRN FVVRYEVNWKTHEIKVKGHN |
| 14 | PRT | Artificial | Luk17 LukAB binding FN3 domain | LPAPKNLVVSRVTEDSARLSWTAPDAAFDSF WITYEEKFYRGEAIVLTVPGSERSYDLTGLKP GTEYKVWIVGVKGGQGSWPLSAIFTT |
| 15 | PRT | Artificial | Luk19 LukAB binding FN3 domain | LPAPKNLVVSRVTEDSARLSWYHAIHRLNHF DSFLIQYQESEKVGEAIVLTVPGSERSYDLAG LKPGTEYTVSIYGVLPDAFVSSNPLSAIFTT |
| 16 | PRT | Artificial | Luk20 LukAB binding FN3 domain | LPAPKNLVVSRVTEDSARLSWYHAIHRLNHF DSFLIQYQESEKVGEAIVLTVPGSERSYDLTGL KPGTEYTVSIYGVLPDAFVSSNPLSAIFTT |
| 17 | PRT | Artificial | Luk24 LukAB binding FN3 domain | LPAPKNLVVSRVTEDSARLSWTAPDAAFDSF QIGYFELWPNGEAIVLTVPGSERSYDLTGLKP GTEYEVFIRGVKGGLYSYPLSAIFTT |
| 18 | PRT | Artificial | Luk8 LukD binding FN3 domain | LPAPKNLVVSRVTEDSARLSWKRKPWAPIFDS FLIQYQESEKVGEAIVLTVPGSERSYDLTGLKP GTEYTVSIYGVWDHAGPKYEIESNPLSAIFTT |

TABLE 6-continued

Nucleic Acid and Amino Acid Sequences of the Disclosure

| SEQ ID NO: | Type | Species | Description | Sequence |
|---|---|---|---|---|
| 19 | PRT | Artificial | Luk9 LukD binding FN3 domain | LPAPKNLVVSRVTEDSARLSWDRTYSLLNYF DSFLIQYQESEKVGEAIVLTVPGSERSYDLTGL KPGTEYTVSIYGVGGQHPTYESNPLSAIFTT |
| 20 | PRT | Artificial | Luk10 LukD binding FN3 domain | LPAPKNLVVSRVTEDSARLSWAASENAFVFD SFLIQYQESEKVGEAIVLTVPGSERSYDLTGLK PGTEYTVSIYGVGGKLHNQFEWLSNPLSAIFTT |
| 21 | PRT | Artificial | Luk11 LukD binding FN3 domain | LPAPKNLVVSRVTEDSARLSWRAKPWAPKFD SFLIQYQESEKVGEAIVLTVPGSERSYDLTGLK PGTEYTVSIYGVSAIKPGHTSNPLSAIFTT |
| 22 | PRT | Artificial | Luk12 LukD binding FN3 domain | LPAPKNLVVSRVTEDSARLSWRAKPWAPKFD SFLIQYQESEKVGEAIVLTVPGSERSYDLTGLK PGTEYTVSIYGVKASEKFIESNPLSAIFTT |
| 23 | PRT | Artificial | Luk21 LukD binding FN3 domain | LPAPKNLVVSRVTEDSARLSWVTKPWAEYFD SFLIQYQESEKVGEAIVLTVPGSERSYDLTGLK PGTEYTVSIYGVWDHAGPKYEIESNPLSAIFTT |
| 24 | PRT | Artificial | Luk22 LukD binding FN3 domain | LPAPKNLVVSRVTEDSARLSWRAKPWAPKFD SFLIQYQESEKVGEAIVLTVPGSERSYDLTGLK PGTEYAVSIYGVKASEKFIESNPLSAIFTT |
| 25 | PRT | Artificial | Luk26 LukE binding FN3 domain | LPAPKNLVVSRVTEDSARLSWTAPDAAFDSF HIEYAEPWVWGEAIVLTVPGSERSYDLTGLKP GTEYVVFIGGVKGGHNSTPLSAIFTT |
| 26 | PRT | Artificial | Luk27 LukE binding FN3 domain | LPAPKNLVVSRVTEDSARLSWTAPDAAFDSFP IVYQEWQFYGEAIVLTVPGSERSYDLTGLKPG TEYLVDIYGVKGGSWSYPLSAIFTT |
| 27 | PRT | Artificial | Luk28 LukE binding FN3 domain | LPAPKNLVVSRVTEDSARLSWTAPDAAFDSF AIQYWEWWPPGEAIVLTVPGSERSYDLTGLK PGTEYGVIILGVKGGWYSNPLSAIFTT |
| 28 | PRT | Artificial | Luk29 LukE binding FN3 domain | LPAPKNLVVSRVTEDSARLSWDEQFVSNFDSF LIQYQESEKVGEAIVLTVPGSERSYDLTGLKP GTEYTVSIYGVFVPWDGFSEINYSNPLSAIFTT |
| 29 | PRT | Artificial | Luk30 LukE binding FN3 domain | LPAPKNLVVSRVTEDSARLSWAFNWNYFAFD SFLIQYQESEKVGEAIVLTVPGSERSYDLTGLK PGTEYTVSIYGVVALNTGNKKSNPLSAIFTT |
| 30 | PRT | Artificial | Luk31 LukE binding FN3 domain | LPAPNNLVVSRVTEDSARLSWDWDKYYTNR FDSFLIQYQESEKVGEAIVLTVPGSERSYDLTG LKPGTEYTVSIYGVLVRDYIRAAEWYSNPLSA IFTT |
| 31 | PRT | Artificial | Luk32 LukE binding FN3 domain | LPAPKNLVVSRVTEDSARLSWYHENAYLLFD SFLIQYQESEKVGEAIVLTVPGSERSYDLTGLK PGTEYTVSIYGVVYDLTPEKRSSNPLSAIFTT |
| 32 | PRT | Artificial | Luk33 LukE binding FN3 domain | LPAPKNLVVSRVTEDSARLSWTAPDAAFDSFL IQYQESEKVGEAIVLTVPGSERSYDLTGLKPG TEYTVSIYGVAFIPDEIEFSNPLSAIFTT |
| 33 | PRT | Artificial | Luk34 LukE binding FN3 domain | LPAPKNLVVSRVTEDSARLSWTAPDAAFDSFL IQYQESEKVGEAIVLTVPGSERSYDLTGPKPG TEYTVSIYGVVVVPHEFEFSNPLSAIFTT |
| 34 | PRT | Artificial | Luk35 LukE binding FN3 domain | LPAPKNLVVSRVTEDSARLSWTAPDAAFDSFL IQYQESEKVGEAIVLTVPGSERSYDLTGLKPG TEYTVSIYGVAHIPWEFEWSKPLSAIFTT |
| 35 | PRT | Artificial | Luk36 LukE binding FN3 domain | LPAPKNLVVSRVTEDSARLSWTAPDAAFDSFL IQYQESEKVGEAIVLTVPGSERSYDLTGLKPG TEYTVSIYGVADVPDEYEFSNPLSAIFTT |
| 36 | PRT | Artificial | Luk37 LukE binding FN3 domain | LPAPKNLVVSRVTEDSARLSWTAPDAAFDSFL IQYQESEKVGEAIVLTVPGSERSYDLTGLKPG TEYTVSIYGVVGWPLFIQSNPLSAIFTT |

TABLE 6-continued

Nucleic Acid and Amino Acid Sequences of the Disclosure

| SEQ ID NO: | Type | Species | Description | Sequence |
|---|---|---|---|---|
| 37 | PRT | Artificial | Luk38 LukE binding FN3 domain | LPAPKNLVVSRVTEDSARLSWTAPDAAFDSFL IQYQESEKVGEAIVLTVPGSERSYDLTGLKPG TEYTVSIYGVELIYHGWLDFVFSNPLSAIFTT |
| 38 | PRT | Artificial | Luk39 LukE binding FN3 domain | LPAPKNLVVSRVTEDSARLSWTAPDAAFDSFL IQYQESEKVGEAIVLTVPGSERSYDLTGLKPG TEYTVSIYGVRVFYFSVEPTWFSNPLSAIFTT |
| 39 | PRT | Artificial | Luk40 LukE binding FN3 domain | LPAPKNLVVSRVTEDSARLSWTAPDAAFDSFL IQYQESEKVGEAIVLTVPGSERSYDLTGLKPG TEYTVSIYGVSYAGEPLLWIYSNPLSAIFTT |
| 40 | PRT | Artificial | Luk41 LukE binding FN3 domain | LPAPKNLVVSRVTEDSARLSWTAPDAAFDSFL IQYQESEKVGEAIVLTVPGSERSYDLTGLKPG TEYTVSIYGVSEVPYSEYWFSNPLSAIFTT |
| 41 | PRT | Artificial | Luk42 LukE binding FN3 domain | LPAPKNLVVSRVTEDSARLSWTAPDAAFDSFL IQYQESEKVGEAIVLTVPGSERSYDLTGLKPG TEYTVSIYGVVWGYRLTTEHSNPLSAIFTT |
| 42 | PRT | Artificial | Luk43 LukE binding FN3 domain | LPAPKNLVVSRVTEDSARLSWTAPDAAFDSFL IQYQESEKVGEAIVLTVPGSERSYDLTGLKPG TEYTVSIYGVNSFGRPTLNLFSNPLSAIFTT |
| 43 | PRT | Artificial | Luk44 LukE binding FN3 domain | LPAPKNLVVSRVTEDSARLSWTAPDAAFDSFL IQYQESEKVGEAIVLTVPGSERSYDLTGLKPG TEYTVSIYGVEWLQYYGETLFSNPLSAIFTT |
| 44 | PRT | Artificial | Luk45 LukE binding FN3 domain | LPAPKNLVVSRVTEDSARLSWTAPDAAFDSFL IQYQESEKVGEAIVLTVPGSERSYDLTGLKPG TEYTVSIYGVAWLTNAYEWEFSNPLSAIFTT |
| 45 | PRT | Artificial | Luk46 LukE binding FN3 domain | LPAPKNLVVSRVTEDSARLSWTAPDAAFDSF WIHYEESTWAGEAIVLTVPGSERSYDLTGLKP GTEYGVVIVGVKGGLKSHPLSAIFTT |
| 46 | PRT | Artificial | Luk47 LukE binding FN3 domain | LPAPKNLVVSRVTEDSARLSWTAPDAAFDSF GIQYFETTESGEAIVLTVPGSERSYDLTGLKPG TEYVVFISGVKGGPLSWPLSAIFTT |
| 47 | PRT | Artificial | Luk48 LukE binding FN3 domain | LPAPKNLVVSRVTEDSARLSWTAPDAAFDSF HIEYGEWWPTGEAIVLTVPGSERSYDLTGLKP GTEYGVLIVGVKGGFRSSPLSAIFTT |
| 48 | PRT | Artificial | Luk49 LukE binding FN3 domain | LPAPKNLVVSRVTEDSARLSWTAPDAAFDSF AIVYAEHWPAGEAIVLTVPGSERSYDLTGLKP GTEYNVTIPGVKGGKYSDPLSAIFTT |
| 49 | PRT | Artificial | Luk50 LukE binding FN3 domain | LPAPKNLVVSRVTEDSARLSWTAPDAAFDSF VIPYSEWWPVGEAIVLTVPGSERSYDLTGLKP GTEYGVYIVGVKGGTWSAPLSAIFTT |
| 50 | PRT | Artificial | Luk51 LukE binding FN3 domain | LPAPKNLVVSRVTEDSARLSWTAPDAAFDSF QIHYFESEPGGEAIVLTVPGSERSYDLTGLKPG TEYVVFIIGVKGGWSSLPLSAIFTT |
| 51 | PRT | Artificial | Luk52 LukE binding FN3 domain | LPAPKNLVVSRVTEDSARLSWTAPDAAFDSF WIQYGEAQEFGEAIVLTVPGSERSYDLTGLKP GTEYIVFITGVKGGNKSYPLSAIFTT |
| 52 | PRT | Artificial | Luk53 LukE binding FN3 domain | LPAPKNLVVSRVTEDSARLSWTAPDAAFDSFT IQYFEAEANGEAIVLTVPGSERSYDLTGLKPG TEYLVFIVGVKGGHSSLPLSAIFTT |
| 53 | PRT | Artificial | Luk54 LukE binding FN3 domain | LPAPKNLVVSRVTEDSARLSWTAPDAVFDSF RIEYSEWWPIGEAIVLTVPGSERSYDLTGLKP GTEYGVVIAGVKGGGYSVPLSAIFTT |
| 54 | PRT | Artificial | Luk55 LukE binding FN3 domain | LPAPKNLVVSRVTEDSARLSWTAPDAAFDSF WIQYFESAGEGEAIVLTVPGSERSYDLTGLKP GTEYLVFIVGVKGGVPSYPLSAIFTT |

TABLE 6-continued

Nucleic Acid and Amino Acid Sequences of the Disclosure

| SEQ ID NO: | Type | Species | Description | Sequence |
|---|---|---|---|---|
| 55 | PRT | Artificial | Luk56 LukE binding FN3 domain | LPAPKNLVVSRVTEDSARLSWTAPDAAFDSF YIQYIELEIGEAIVLTVPGSERSYDLTGLKPGTE YGVFISGVKGGWNSYPLSAIFTT |
| 56 | PRT | Artificial | Luk57 LukE binding FN3 domain | LPAPKNLVVSRVTEDSARLSWTAPDAAFNSF YIEYFEWFPAGEAIVLTVPGSERSYDLTGLKP GTEYAVIIHGVKGGQRSTPLSAIFTT |
| 57 | PRT | Artificial | Luk58 LukE binding FN3 domain | LPAPKNLVVSRVTEDSARLSWTAPDAAFDSF DIEYDESAHFGEAIVLTVPGSERSYDLTGLKP GTEYIVFIYGVKGGYASIPLSAIFTT |
| 58 | PRT | Artificial | Luk59 LukE binding FN3 domain | LPAPKNLVVSRVTEDSARLSWTAPDAAFDSF DISYNEFAWSGEAIVLTVPGSERSYDLTGLKP GTEYVVYIHGVKGGPTSYPLSAIFTT |
| 59 | PRT | Artificial | Luk60 LukE binding FN3 domain | LPAPKNLVVSRVTEDSARLSWTAPDAAFDSF DIQYWEWWPFGEAIVLTVPGSERSYDLTGLK PGTEYGVIILGVKGGFRSTPLSAIFTT |
| 60 | PRT | Human | CR5133 Heavy Chain | EVQLVETGGGLVKPGGSLRLSCSASRFSFRDY YMTWIRQAPGKGPEWVSHISGSGSTIYYADS VRGRFTISRDNAKSSLYLQMDSLQADDTAVY YCARGGRATSYYWVHWGPGTLVTVSSASTK GPSVFPLAPSSKSTSGGTAALGCLVKDYFPEP VTVSWNSGALTSGVHTFPAVLQSSGLYSLSSV VTVPSSSLGTQTYICNVNHKPSNTKVDKKVEP KSCDKTHTCPPCPAPELLGGPSVFLFPPKPKDT LMISRTPEVTCVVVDVSHEDPEVKFNWYVDG VEVHNAKTKPREEQYNSTYRVVSVLTVLHQD WLNGKEYKCKVSNKALPAPIEKTISKAKGQP REPQVYTLPPSRDELTKNQVSLTCLVKGFYPS DIAVEWESNGQPENNYKTTPPVLDSDGSFFLY SKLTVDKSRWQQGNVFSCSVMHEALHNHYT QKSLSLSPGK |
| 61 | PRT | Human | CR5133 Light Chain | EIVLTQSPATLSLSPGERATLSCRASQSVSGYL GWYQQKPGQAPRLLIYGASSRATGIPDRFSGS GSGTDFTLTISRLEPEDFAVYYCQQYGSSPLTF GGGTKLEIKRTVAAPSVFIFPPSDEQLKSGTAS VVCLLNNFYPREAKVQWKVDNALQSGNSQE SVTEQDSKDSTYSLSSTLTLSKADYEKHKVYA CEVTHQGLSSPVTKSFNRGEC |
| 62 | PRT | Human | CR5133 PRASA Heavy Chain | EVQLVETGGGLVKPGGSLRLSCSASRFSFRDY YMTWIRQAPGKGPEWVSHISGSGSTIYYADS VRGRFTISRDNAKSSLYLQMDSLQADDTAVY YCARGGRATSYYWVHWGPGTLVTVSSASTK GPSVFPLAPSSKSTSGGTAALGCLVKDYFPEP VTVSWNSGALTSGVHTFPAVLQSSGLYSLSSV VTVPSSSLGTQTYICNVNHKPSNTKVDKKVEP KSCDKTHTCPPCPAPPVAGPDVFLFPPKPKDT LMISRTPEVTCVVVDVSHEDPEVKFNWYVDG VEVHNAKTKPREEQYNSTYRVVSVLTVLHQD WLNGKEYKCKVSNAALPAPIAKTISKAKGQP REPQVYTLPPSRDELTKNQVSLTCLVKGFYPS DIAVEWESNGQPENNYKTTPPVLDSDGSFFLY SKLTVDKSRWQQGNVFSCSVMHEALHNHYT QKSLSLSPGK |
| 63 | PRT | Human | CR5133 PRASA Light Chain | EIVLTQSPATLSLSPGERATLSCRASQSVSGYL GWYQQKPGQAPRLLIYGASSRATGIPDRFSGS GSGTDFTLTISRLEPEDFAVYYCQQYGSSPLTF GGGTKLEIKRTVAAPSVFIFPPSDEQLKSGTAS VVCLLNNFYPREAKVQWKVDNALQSGNSQE SVTEQDSKDSTYSLSSTLTLSKADYEKHKVYA CEVTHQGLSSPVTKSFNRGEC |
| 64 | PRT | Human | CR5133 A6 Heavy Chain | EVQLVETGGGLVKPGGSLRLSCSASRFSFRDY YMTWIRQAPGKGPEWVSHISGSGSTIYYADS VRGRFTISRDNAKSSLYLQMDSLQADDTAVY YCARGGRATSYYWVHWGPGTLVTVSSASTK GPSVFPLAPSSKSTSGGTAALGCLVKDYFPEP VTVSWNSGALTSGVHTFPAVLQSSGLYSLSSV |

TABLE 6-continued

Nucleic Acid and Amino Acid Sequences of the Disclosure

| SEQ ID NO: | Type | Species | Description | Sequence |
|---|---|---|---|---|
| | | | | VTVPSSSLGTQTYICNVNHKPSNTKVDKKVEP KSCDKTHTCPPCPAPELLGGPSVFLFPPKPKDT LMISRTPEVTCVVVDVSHEDPEVKFNWYVDG VEVHNAKTKPREEQYNSTYRVVSVLTVLHQD WLNGKEYKCKVSNKALPAPIEKTISKAKGQP REPQVYTLPPSRDELTKNQVSLTCLVKGFYPS DIAVEWESNGQPENNYKTTPPVLDSDGSFFLY SKLTVDKSRWQQGNVFSCSVMHEALHNRFT QKSLSLSPGK |
| 65 | PRT | Human | CR5133 A6 Light Chain | EIVLTQSPATLSLSPGERATLSCRASQSVSGYL GWYQQKPGQAPRLLIYGASSRATGIPDRFSGS GSGTDFTLTISRLEPEDFAVYYCQQYGSSPLTF GGGTKLEIKRTVAAPSVFIFPPSDEQLKSGTAS VVCLLNNFYPREAKVQWKVDNALQSGNSQE SVTEQDSKDSTYSLSSTLTLSKADYEKHKVYA CEVTHQGLSSPVTKSFNRGEC |
| 66 | PRT | Human | CR5133 PRASA A6 Heavy Chain | EVQLVETGGGLVKPGGSLRLSCSASRFSFRDY YMTWIRQAPGKGPEWVSHISGSGSTIYYADS VRGRFTISRDNAKSSLYLQMDSLQADDTAVY YCARGGRATSYYWVHWGPGTLVTVSSASTK GPSVFPLAPSSKSTSGGTAALGCLVKDYFPEP VTVSWNSGALTSGVHTFPAVLQSSGLYSLSSV VTVPSSSLGTQTYICNVNHKPSNTKVDKKVEP KSCDKTHTCPPCPAPPVAGPDVFLFPPKPKDT LMISRTPEVTCVVVDVSHEDPEVKFNWYVDG VEVHNAKTKPREEQYNSTYRVVSVLTVLHQD WLNGKEYKCKVSNAALPAPIAKTISKAKGQP REPQVYTLPPSRDELTKNQVSLTCLVKGFYPS DIAVEWESNGQPENNYKTTPPVLDSDGSFFLY SKLTVDKSRWQQGNVFSCSVMHEALHNRFT QKSLSLSPGK |
| 67 | PRT | Human | CR5133 PRASA A6 Light Chain | EIVLTQSPATLSLSPGERATLSCRASQSVSGYL GWYQQKPGQAPRLLIYGASSRATGIPDRFSGS GSGTDFTLTISRLEPEDFAVYYCQQYGSSPLTF GGGTKLEIKRTVAAPSVFIFPPSDEQLKSGTAS VVCLLNNFYPREAKVQWKVDNALQSGNSQE SVTEQDSKDSTYSLSSTLTLSKADYEKHKVYA CEVTHQGLSSPVTKSFNRGEC |
| 68 | PRT | Artificial | CR5133 PRASA A6 LC-D Heavy Chain | EVQLVETGGGLVKPGGSLRLSCSASRFSFRDY YMTWIRQAPGKGPEWVSHISGSGSTIYYADS VRGRFTISRDNAKSSLYLQMDSLQADDTAVY YCARGGRATSYYWVHWGPGTLVTVSSASTK GPSVFPLAPSSKSTSGGTAALGCLVKDYFPEP VTVSWNSGALTSGVHTFPAVLQSSGLYSLSSV VTVPSSSLGTQTYICNVNHKPSNTKVDKKVEP KSCDKTHTCPPCPAPPVAGPDVFLFPPKPKDT LMISRTPEVTCVVVDVSHEDPEVKFNWYVDG VEVHNAKTKPREEQYNSTYRVVSVLTVLHQD WLNGKEYKCKVSNAALPAPIAKTISKAKGQP REPQVYTLPPSRDELTKNQVSLTCLVKGFYPS DIAVEWESNGQPENNYKTTPPVLDSDGSFFLY SKLTVDKSRWQQGNVFSCSVMHEALHNRFT QKSLSLSPGK |
| 69 | PRT | Artificial | CR5133 PRASA A6 LC-D Light Chain | EIVLTQSPATLSLSPGERATLSCRASQSVSGYL GWYQQKPGQAPRLLIYGASSRATGIPDRFSGS GSGTDFTLTISRLEPEDFAVYYCQQYGSSPLTF GGGTKLEIKRTVAAPSVFIFPPSDEQLKSGTAS VVCLLNNFYPREAKVQWKVDNALQSGNSQE SVTEQDSKDSTYSLSSTLTLSKADYEKHKVYA CEVTHQGLSSPVTKSFNRGECGGGGSGGGGS GGGGSGGGGSLPAPKNLVVSRVTEDSARLSW RAKPWAPKFDSFLIQYQESEKVGEAIVLTVPG SERSYDLTGLKPGTEYTVSIYGVKASEKFIESN PLSAIFTT |
| 70 | PRT | Artificial | CR5133 PRASA A6 HC-AB Heavy Chain | EVQLVETGGGLVKPGGSLRLSCSASRFSFRDY YMTWIRQAPGKGPEWVSHISGSGSTIYYADS VRGRFTISRDNAKSSLYLQMDSLQADDTAVY YCARGGRATSYYWVHWGPGTLVTVSSASTK GPSVFPLAPSSKSTSGGTAALGCLVKDYFPEP |

TABLE 6-continued

Nucleic Acid and Amino Acid Sequences of the Disclosure

| SEQ ID NO: | Type | Species | Description | Sequence |
|---|---|---|---|---|
| | | | | VTVSWNSGALTSGVHTFPAVLQSSGLYSLSSV VTVPSSSLGTQTYICNVNHKPSNTKVDKKVEP KSCDKTHTCPPCPAPPVAGPDVFLFPPKPKDT LMISRTPEVTCVVVDVSHEDPEVKFNWYVDG VEVHNAKTKPREEQYNSTYRVVSVLTVLHQD WLNGKEYKCKVSNAALPAPIAKTISKAKGQP REPQVYTLPPSRDELTKNQVSLTCLVKGFYPS DIAVEWESNGQPENNYKTTPPVLDSDGSFFLY SKLTVDKSRWQQGNVFSCSVMHEALHNRFT QKSLSLSPGKGGGGSGGGGSGGGGSGGGGS MLPAPKNLVVSRVTEDSARLSWTAPDAAFDS FWITYEEKFYRGEAIVLTVPGSERSYDLTGLK PGTEYKVWIVGVKGGQGSWPLSAIFTT |
| 71 | PRT | Artificial | CR5133 PRASA A6 HC-AB Light Chain | EIVLTQSPATLSLSPGERATLSCRASQSVSGYL GWYQQKPGQAPRLLIYGASSRATGIPDRFSGS GSGTDFTLTISRLEPEDFAVYYCQQYGSSPLTF GGGTKLEIKRTVAAPSVFIFPPSDEQLKSGTAS VVCLLNNFYPREAKVQWKVDNALQSGNSQE SVTEQDSKDSTYSLSSTLTLSKADYEKHKVYA CEVTHQGLSSPVTKSFNRGEC |
| 72 | PRT | Artificial | CR5133 PRASA A6 LC-D HC-AB Heavy Chain | EVQLVETGGGLVKPGGSLRLSCSASRFSFRDY YMTWIRQAPGKGPEWVSHISGSGSTIYYADS VRGRFTISRDNAKSSLYLQMDSLQADDTAVY YCARGGRATSYYWVHWGPGTLVTVSSASTK GPSVFPLAPSSKSTSGGTAALGCLVKDYFPEP VTVSWNSGALTSGVHTFPAVLQSSGLYSLSSV VTVPSSSLGTQTYICNVNHKPSNTKVDKKVEP KSCDKTHTCPPCPAPPVAGPDVFLFPPKPKDT LMISRTPEVTCVVVDVSHEDPEVKFNWYVDG VEVHNAKTKPREEQYNSTYRVVSVLTVLHQD WLNGKEYKCKVSNAALPAPIAKTISKAKGQP REPQVYTLPPSRDELTKNQVSLTCLVKGFYPS DIAVEWESNGQPENNYKTTPPVLDSDGSFFLY SKLTVDKSRWQQGNVFSCSVMHEALHNRFT QKSLSLSPGKGGGGSGGGGSGGGGSGGGGS MLPAPKNLVVSRVTEDSARLSWTAPDAAFDS FWITYEEKFYRGEAIVLTVPGSERSYDLTGLK PGTEYKVWIVGVKGGQGSWPLSAIFTT |
| 73 | PRT | Artificial | CR5133 PRASA A6 LC-D HC-AB Light Chain | EIVLTQSPATLSLSPGERATLSCRASQSVSGYL GWYQQKPGQAPRLLIYGASSRATGIPDRFSGS GSGTDFTLTISRLEPEDFAVYYCQQYGSSPLTF GGGTKLEIKRTVAAPSVFIFPPSDEQLKSGTAS VVCLLNNFYPREAKVQWKVDNALQSGNSQE SVTEQDSKDSTYSLSSTLTLSKADYEKHKVYA CEVTHQGLSSPVTKSFNRGECGGGGSGGGGS GGGGSGGGGSLPAPKNLVVSRVTEDSARLSW RAKPWAPKFDSFLIQYQESEKVGEAIVLTVPG SERSYDLTGLKPGTEYTVSIYGVKASEKFIESN PLSAIFTT |
| 74 | PRT | Artificial | CR5133 PRASA A6 HC-D Heavy Chain | EVQLVETGGGLVKPGGSLRLSCSASRFSFRDY YMTWIRQAPGKGPEWVSHISGSGSTIYYADS VRGRFTISRDNAKSSLYLQMDSLQADDTAVY YCARGGRATSYYWVHWGPGTLVTVSSASTK GPSVFPLAPSSKSTSGGTAALGCLVKDYFPEP VTVSWNSGALTSGVHTFPAVLQSSGLYSLSSV VTVPSSSLGTQTYICNVNHKPSNTKVDKKVEP KSCDKTHTCPPCPAPPVAGPDVFLFPPKPKDT LMISRTPEVTCVVVDVSHEDPEVKFNWYVDG VEVHNAKTKPREEQYNSTYRVVSVLTVLHQD WLNGKEYKCKVSNAALPAPIAKTISKAKGQP REPQVYTLPPSRDELTKNQVSLTCLVKGFYPS DIAVEWESNGQPENNYKTTPPVLDSDGSFFLY SKLTVDKSRWQQGNVFSCSVMHEALHNRFT QKSLSLSPGKGGGGSGGGGSGGGGSGGGGSL PAPKNLVVSRVTEDSARLSWRAKPWAPKFDS FLIQYQESEKVGEAIVLTVPGSERSYDLTGLKP GTEYTVSIYGVKASEKFIESNPLSAIFTT |
| 75 | PRT | Artificial | CR5133 PRASA A6 HC-D Light Chain | EIVLTQSPATLSLSPGERATLSCRASQSVSGYL GWYQQKPGQAPRLLIYGASSRATGIPDRFSGS GSGTDFTLTISRLEPEDFAVYYCQQYGSSPLTF |

TABLE 6-continued

Nucleic Acid and Amino Acid Sequences of the Disclosure

| SEQ ID NO: | Type | Species | Description | Sequence |
|---|---|---|---|---|
| | | | | GGGTKLEIKRTVAAPSVFIFPPSDEQLKSGTAS VVCLLNNFYPREAKVQWKVDNALQSGNSQE SVTEQDSKDSTYSLSSTLTLSKADYEKHKVYA CEVTHQGLSSPVTKSFNRGEC |
| 76 | PRT | Artificial | CR5133 PRASA A6 HC AB-D Heavy Chain | EVQLVETGGGLVKPGGSLRLSCSASRFSFRDY YMTWIRQAPGKGPEWVSHISGSGSTIYYADS VRGRFTISRDNAKSSLYLQMDSLQADDTAVY YCARGGRATSYYWVHWGPGTLVTVSSASTK GPSVFPLAPSSKSTSGGTAALGCLVKDYFPEP VTVSWNSGALTSGVHTFPAVLQSSGLYSLSSV VTVPSSSLGTQTYICNVNHKPSNTKVDKKVEP KSCDKTHTCPPCPAPPVAGPDVFLFPPKPKDT LMISRTPEVTCVVVDVSHEDPEVKFNWYVDG VEVHNAKTKPREEQYNSTYRVVSVLTVLHQD WLNGKEYKCKVSNAALPAPIAKTISKAKGQP REPQVYTLPPSRDELTKNQVSLTCLVKGFYPS DIAVEWESNGQPENNYKTTPPVLDSDGSFFLY SKLTVDKSRWQQGNVFSCSVMHEALHNRFT QKSLSLSPGKGGGGSGGGGSGGGGSGGGGS MLPAPKNLVVSRVTEDSARLSWTAPDAAFDS FWITYEEKFYRGEAIVLTVPGSERSYDLTGLK PGTEYKVWIVGVKGGQGSWPLSAIFTTGGGG SGGGGSGGGGSGGGGSLPAPKNLVVSRVTED SARLSWRAKPWAPKFDSFLIQYQESEKVGEAI VLTVPGSERSYDLTGLKPGTEYTVSIYGVKAS EKFIESNPLSAIFTT |
| 77 | PRT | Artificial | CR5133 PRASA A6 HC AB-D Light Chain | EIVLTQSPATLSLSPGERATLSCRASQSVSGYL GWYQQKPGQAPRLLIYGASSRATGIPDRFSGS GSGTDFTLTISRLEPEDFAVYYCQQYGSSPLTF GGGTKLEIKRTVAAPSVFIFPPSDEQLKSGTAS VVCLLNNFYPREAKVQWKVDNALQSGNSQE SVTEQDSKDSTYSLSSTLTLSKADYEKHKVYA CEVTHQGLSSPVTKSFNRGEC |
| 78 | PRT | Artificial | CR5133 PRASA A6 HC D-AB Heavy Chain | EVQLVETGGGLVKPGGSLRLSCSASRFSFRDY YMTWIRQAPGKGPEWVSHISGSGSTIYYADS VRGRFTISRDNAKSSLYLQMDSLQADDTAVY YCARGGRATSYYWVHWGPGTLVTVSSASTK GPSVFPLAPSSKSTSGGTAALGCLVKDYFPEP VTVSWNSGALTSGVHTFPAVLQSSGLYSLSSV VTVPSSSLGTQTYICNVNHKPSNTKVDKKVEP KSCDKTHTCPPCPAPPVAGPDVFLFPPKPKDT LMISRTPEVTCVVVDVSHEDPEVKFNWYVDG VEVHNAKTKPREEQYNSTYRVVSVLTVLHQD WLNGKEYKCKVSNAALPAPIAKTISKAKGQP REPQVYTLPPSRDELTKNQVSLTCLVKGFYPS DIAVEWESNGQPENNYKTTPPVLDSDGSFFLY SKLTVDKSRWQQGNVFSCSVMHEALHNRFT QKSLSLSPGKGGGGSGGGGSGGGGSGGGGSL PAPKNLVVSRVTEDSARLSWRAKPWAPKFDS FLIQYQESEKVGEAIVLTVPGSERSYDLTGLKP GTEYTVSIYGVKASEKFIESNPLSAIFTTGGGG SGGGGSGGGGSGGGGSMLPAPKNLVVSRVTE DSARLSWTAPDAAFDSFWITYEEKFYRGEAIV LTVPGSERSYDLTGLKPGTEYKVWIVGVKGG QGSWPLSAIFTT |
| 79 | PRT | Artificial | CR5133 PRASA A6 HC D-AB Light Chain | EIVLTQSPATLSLSPGERATLSCRASQSVSGYL GWYQQKPGQAPRLLIYGASSRATGIPDRFSGS GSGTDFTLTISRLEPEDFAVYYCQQYGSSPLTF GGGTKLEIKRTVAAPSVFIFPPSDEQLKSGTAS VVCLLNNFYPREAKVQWKVDNALQSGNSQE SVTEQDSKDSTYSLSSTLTLSKADYEKHKVYA CEVTHQGLSSPVTKSFNRGEC |
| 80 | DNA | Artificial | BC6 | GTGACACGGCGGTTAGAACGCGGCTACAAT TAATACATAACCCCCATCCCCCTGTTGACAAT TAATCATCGGCTCGTATAATGTGTGGAATTG TGAGCGGATAACAATTTCACACAGGAAACA GGATCTACCATGCTGCCGGCGCCGAAAAAC CTGGTTGTTTCTGAAGTTACCGAAGACTCTC TGCGTCTGTCTTGGNNNNNNNNNNNNNNNN NNTTYGACTCTTTCCTGATCCAGTACCAGGA |

TABLE 6-continued

Nucleic Acid and Amino Acid Sequences of the Disclosure

| SEQ ID NO: | Type | Species | Description | Sequence |
|---|---|---|---|---|
| | | | | ATCTGAAAAAGTTGGTGAAGCGATCAACCT GACCGTTCCGGGTTCTGAACGTTCTTACGAC CTGACCGGTCTGAAACCGGGTACCGAATAC ACCGTTTCTATCTACGGTGTTCTTAGAAGCT TCCCAAAGGC |
| 81 | DNA | Artificial | BC7 | GTGACACGGCGGTTAGAACGCGGCTACAAT TAATACATAACCCCATCCCCCTGTTGACAAT TAATCATCGGCTCGTATAATGTGTGGAATTG TGAGCGGATAACAATTTCACACAGGAAACA GGATCTACCATGCTGCCGGCGCCGAAAAAC CTGGTTGTTTCTGAAGTTACCGAAGACTCTC TGCGTCTGTCTTGGNNNNNNNNNNNNNNNN NNNNNTTYGACTCTTTCCTGATCCAGTACCA GGAATCTGAAAAGTTGGTGAAGCGATCAA CCTGACCGTTCCGGGTTCTGAACGTTCTTAC GACCTGACCGGTCTGAAACCGGGTACCGAA TACACCGTTTCTATCTACGGTGTTCTTAGAA GCTTCCCAAAGGC |
| 82 | DNA | Artificial | BC8 | GTGACACGGCGGTTAGAACGCGGCTACAAT TAATACATAACCCCATCCCCCTGTTGACAAT TAATCATCGGCTCGTATAATGTGTGGAATTG TGAGCGGATAACAATTTCACACAGGAAACA GGATCTACCATGCTGCCGGCGCCGAAAAAC CTGGTTGTTTCTGAAGTTACCGAAGACTCTC TGCGTCTGTCTTGGNNNNNNNNNNNNNNNN NNNNNNNNTTYGACTCTTTCCTGATCCAGT ACCAGGAATCTGAAAAGTTGGTGAAGCGA TCAACCTGACCGTTCCGGGTTCTGAACGTTC TTACGACCTGACCGGTCTGAAACCGGGTAC CGAATACACCGTTTCTATCTACGGTGTTCTT AGAAGCTTCCCAAAGGC |
| 83 | DNA | Artificial | BC9 | GTGACACGGCGGTTAGAACGCGGCTACAAT TAATACATAACCCCATCCCCCTGTTGACAAT TAATCATCGGCTCGTATAATGTGTGGAATTG TGAGCGGATAACAATTTCACACAGGAAACA GGATCTACCATGCTGCCGGCGCCGAAAAAC CTGGTTGTTTCTGAAGTTACCGAAGACTCTC TGCGTCTGTCTTGGNNNNNNNNNNNNNNNN NNNNNNNNNNNTTYGACTCTTTCCTGATCC AGTACCAGGAATCTGAAAAGTTGGTGAAG CGATCAACCTGACCGTTCCGGGTTCTGAAC GTTCTTACGACCTGACCGGTCTGAAACCGG GTACCGAATACACCGTTTCTATCTACGGTGT TCTTAGAAGCTTCCCAAAGGC |
| 84 | DNA | Artificial | 130mer-L17A | CGGCGGTTAGAACGCGGCTACAATTAATAC ATAACCCCATCCCCCTGTTGACAATTAATCA TCGGCTCGTATAATGTGTGGAATTGTGAGC GGATAACAATTTCACACAGGAAACAGGATC TACCATGCTG |
| 85 | DNA | Artificial | POP2222ext | CGG CGG TTA GAA CGC GGC TAC AAT TAA TAC |
| 86 | DNA | Artificial | LS1114 | CCA AGA CAG ACG GGC AGA GTC TTC GGT AAC GCG AGA AAC AAC CAG GTT TTT CGG CGC CGG CAG CAT GGT AGA TCC TGT TTC |
| 87 | DNA | Artificial | LS1115 | CCG AAG ACT CTG CCC GTC TGT CTT GG |
| 88 | DNA | Artificial | LS1117 | CAG TGG TCT CAC GGA TTC CTG GTA CTG GAT CAG GAA AGA GTC GAA |
| 89 | DNA | Artificial | SDG10 | CATGCGGTCTCTTCCGAAAAAGTTGGTGAA GCGATCGTCCTGACCGTTCCGGGT |
| 90 | DNA | Artificial | SDG24 | GGTGGTGAAGATCGCAGACAGCGGGTTAG |
| 91 | DNA | Artificial | SDG28 | AAGATCAGTTGCGGCCGCTAGACTAGAACC GCTGCCACCGCCGGTGGTGAAGATCGCAGAC |

TABLE 6-continued

Nucleic Acid and Amino Acid Sequences of the Disclosure

| SEQ ID NO: | Type | Species | Description | Sequence |
|---|---|---|---|---|
| 92 | PRT | Artificial | TCL19 | LPAPKNLVVSRVTEDSARLSWTAPDAAFDSFXI XYXEXXXXGEAIVLTVPGSERSYDLTGLKPGTE YXVXIXGVKGGXXSXPLSAIFTT; wherein "X" is an equal mixture of 18 amino acids (no cysteine or methionine) |
| 93 | PRT | Artificial | TCL19 C strand | DSFXIXYXE, wherein "X" is an equal mixture of 18 acids (no cysteine or methionine) |
| 94 | PRT | Artificial | TCL19 F strand | TEYXVXIXGV, wherein "X" is an equal mixture of 18 amino acids (no cysteine or methionine) |
| 95 | PRT | Artificial | TCL19 C strand + CD loop | DSFXIXYXEXXXXGE, wherein "X" is an equal mixture of 18 amino acids (no cysteine or methionine) |
| 96 | PRT | Artificial | TCL19 F strand + FG loop | TEYXVXIXGVKGGXXSX, wherein "X" is an equal mixture of 18 amino acids (no cysteine or methionine) |
| 97 | PRT | Artificial | TCL19 A strand + AB loop + B strand + BC loop | LPAPKXLXVXXVXXXXAXLXWXAPDAAF, wherein "X" is an equal mixture of 18 amino acids (no cysteine or methionine) |
| 98 | PRT | Artificial | TCL19 E strand | XYXLT, wherein "X" is an equal mixture of 18 amino acids (no cysteine or methionine) |
| 99 | PRT | S. aureus | SdgB glycosyltransferase | MKETAAAKFERQHMDSPDLGTLVPRGSMA MNYFVGNSLGVNLTGIEKAIINRLNLFKEMG RPAQCVFLSWNRYLYRNAQNYITSSDYINMY DFFQEATYLERNEPFDWLSYWTDECHYTLK HVENSHDFRIYDQERFLMYAHFQDPKYRILD YVNHFDSQRRKVKRDFYDVRGFLSCSRILVD KQQTLCEFFYNPEDDTKLEKYFSYKDGKPEV QKIIVYYANKQYFFNNETELGAFFIKQLYQH GDLFFSDRNVYTAPIFNLTPESIPVVAVLHST HIKNIDALDSSPFKNVYKAMFENLSRYRAIIV STEQQKLDVEKRINHTIPVVNIPVGYSETIDTP VQTLDQRSVKLISVARYSPEKQLHQQIELIKR LVSYVPKIELHMYGFGSESKKLNELIQKYGLE NHVYLRGFLSNLDQEYSDAYLSLITSNMEGF SLALLESLAHGVPVISYDIKYGPNELITSDFNG YLITKNDEDALFDKVKYVIDHPEVQQRLSKG SLAKAQQYSKASLIKQWDQFVRLILEHHHHH |
| 100 | PRT | S. aureus | SdrC4 | MAEHTNGELNQSKNETTAPSENKTTKKVDS RQLKDNTQTATADQPKVTMSDSATVKETSS NMQSPQNATANQSTTKTSNVTTNDKSSTTYS NETDKSNLTQAKDVSTTPKTTTIKPRTLNRM AVNTVAAPQQGTNVNDKVHFSNIDIAIDKGH VNQTTGKTEFWATSSDVLKLKANYTIDDSVK EGDTFTFKYGQYFRPGSVRLPSQTQNLYNAQ GNIIAKGIYDSTTNTTYTFTNYVDQYTNVRG SFEQVAFAKRKNATTDKTAYKMEVTLGNDT YSEEIIVDYGNKKAQPLISSTNYINNEDLSRN MTAYVNQPKNTYTKQTFVTNLTGYKFNPNA KNFKIYEVTDQNQFVDSFTPDTSKLKDVTDQ FDVIYSNDNKTATVDLMKGQTSSNKQYIIQQ VAYPDNSSTDNGKIDYTLDTDKTKYSWSNSY SNVNGSSTANGDQKKYNLGDYVWEDTNKD GKQDANEKGIKGVYVILKDSNGKELDRTTTD ENGKYQFTGLSNGTYSVEFSTPAGYTPTTAN VGTDDAVDSDGLTTTGVIKDADNMTLDSGF YKTPKYSLGDYVWYDSNKDGKQDSTEKGIK GVKVTLQNEKGEVIGTTETDENGKYRFDNLD SGKYKVIFEKPAGLTQTGTNTTEDDKDADGG EVDVTITDHDDFTLDNGYYEEETSDSDSDSD SDSDSDSDSDSDSDSDSDSDSDSDSDSDSD SDSDSDSDSNSDSDSDSDSDSDSDSDSDSD SDSDSDSDSDSDSDSDSDSDSDSDSDSDSD SDSDSDSDSDSDSDSDSDSDSDSDSDSDSD SDSDSDSDSDSDSDSDSDSDNDSDSDSDSD SDAGKHTPAKPMSTVKDQHKTAKALEHHHH HH |

TABLE 6-continued

Nucleic Acid and Amino Acid Sequences of the Disclosure

| SEQ ID NO: | Type | Species | Description | Sequence |
|---|---|---|---|---|
| 101 | PRT | S. aureus | SdrC5 | MTPKYSLGDYVWYDSNKDGKQDSTEKGIKG VKVTLQNEKGEVIGTTETDENGKYRFDNLDS GKYKVIFEKPAGLTQTGTNTTEDDKDADGGE VDVTITDHDDFTLDNGYYEEETSDSDSDSDS DSDSDSDSDSDSDSDSDSDSDSDSDSDSDS DSDSDSDSNSDSDSDSDSDSDSDSDSDSDS DSDSDSDSDSDSDSDSDSDSDSDSDSDSDS DSDSDSDSDSDSDSDSDSDSDSDSDSDSDS DSDSDSDSDSDSDSDSDSDNDSDSDSDSDS DAGKHTPAKPMSTVKDQHKTAKALPETGLE HHHHHH |
| 102 | PRT | Human | Pagibaximab Heavy Chain | EVMLVESGGGLVQPKGSLKLSCAASGFTFNN YAMNWVRQAPGKGLEWVARIRSKSNNYAT FYADSVKDRFTISRDDSQSMLYLQMNNLKTE DTAMYYCVRRGASGIDYAMDYWGQGTSLT VSSASTKGPSVFPLAPSSKSTSGGTAALGCLV KDYFPEPVTVSWNSGALTSGVHTFPAVLQSS GLYSLSSVVTVPSSSLGTQTYICNVNHKPSNT KVDKKVEPKSCDKTHTCPPCPAPELLGGPSV FLFPPKPKDTLMISRTPEVTCVVVDVSHEDPE VKFNWYVDGVEVHNAKTKPREEQYNSTYR VVSVLTVLHQDWLNGKEYKCKVSNKALPAP IEKTISKAKGQPREPQVYTLPPSRDELTKNQV SLTCLVKGFYPSDIAVEWESNGQPENNYKTT PPVLDSDGSFFLYSKLTVDKSRWQQGNVFSC SVMHEALHNHYTQKSLSLSPGK |
| 103 | PRT | Human | Pagibaximab Light Chain | DIVLSQSPAILSASPGEKVTMTCRASSSVNYM HWYQQKPGSSPKPWISATSNLASGVPARFSG SGSGTSYSLTISRVEAEDAATYYCQQWSSNPP TFGGGTMLEIKRTVAAPSVFIFPPSDEQLKSG TASVVCLLNNFYPREAKVQWKVDNALQSGN SQESVTEQDSKDSTYSLSSTLTLSKADYEKHK VYACEVTHQGLSSPVTKSFNRGEC |
| 104 | PRT | Human | CNTO3930 Heavy Chain | QITLKESGPTLVKPTQTLTLTCTFSGFSLSTSG MGVSWIRQPPGKALEWLAHIYWDDDKRYNP SLKSRLTITKDTSKNQVVLTMTNMDPVDTAT YYCARLYGFTYGFAYWGQGTLVTVSSASTK GPSVFPLAPSSKSTSGGTAALGCLVKDYFPEP VTVSWNSGALTSGVHTFPAVLQSSGLYSLSS VVTVPSSSLGTQTYICNVNHKPSNTKVDKKV EPKSCDKTHTCPPCPAPELLGGPSVFLFPPKP KDTLMISRTPEVTCVVVDVSHEDPEVKFNWY VDGVEVHNAKTKPREEQYNSTYRVVSVLTV LHQDWLNGKEYKCKVSNKALPAPIEKTISKA KGQPREPQVYTLPPSRDELTKNQVSLTCLVK GFYPSDIAVEWESNGQPENNYKTTPPVLDSD GSFFLYSKLTVDKSRWQQGNVFSCSVMHEA LHNHYTQKSLSLSPGK |
| 105 | PRT | Human | CNTO3930 Light Chain | DIVMTQSPDSLAVSLGERATINCRASQSVDY NGISYMHWYQQKPGQPPKLLIYAASNPESGV PDRFSGSGSGTDFTLTISSLQAEDVAVYYCQQ IIEDPWTFGQGTKVEIKRTVAAPSVFIFPPSDE QLKSGTASVVCLLNNFYPREAKVQWKVDNA LQSGNSQESVTEQDSKDSTYSLSSTLTLSKAD YEKHKVYACEVTHQGLSSPVTKSFNRGEC |
| 106 | PRT | Human | CNTO3929 Heavy Chain | QITLKESGPTLVKPTQTLTLTCTFSGFSLSTSG MGVSWIRQPPGKALEWLAHIYWDDDKRYNP SLKSRLTITKDTSKNQVVLTMTNMDPVDTAT YYCARLYGFTYGFAYWGQGTLVTVSSASTK GPSVFPLAPSSKSTSGGTAALGCLVKDYFPEP VTVSWNSGALTSGVHTFPAVLQSSGLYSLSS VVTVPSSSLGTQTYICNVNHKPSNTKVDKKA EPKSCDKTHTCPPCPAPELLGGPSVFLFPPKP KDTLMISRTPEVTCVVVDVSHEDPEVKFNWY VDGVEVHNAKTKPREEQYNSTYRVVSVLTV LHQDWLNGKEYKCKVSNKALPAPIEKTISKA KGQPREPQVYTLPPSRDELTKNQVSLTCLVK |

TABLE 6-continued

Nucleic Acid and Amino Acid Sequences of the Disclosure

| SEQ ID NO: | Type | Species | Description | Sequence |
|---|---|---|---|---|
| | | | | GFYPSDIAVEWESNGQPENNYKTTPPVLDSD GSFFLYSKLTVDKSRWQQGNVFSCSVMHEA LHNHYTQKSLSLSPGK |
| 107 | PRT | Human | CNTO3929 Light Chain | DIVMTQSPDSLAVSLGERATINCRASQSVDY NGISYMHWYQQKPGQPPKLLIYAASNPESGV PDRFSGSGSGTDFTLTISSLQAEDVAVYYCQQ IIEDPWTFGQGTKVEIKRTVAAPSVFIFPPSDE QLKSGTASVVCLLNNFYPREAKVQWKVDNA LQSGNSQESVTEQDSKDSTYSLSSTLTLSKAD YEKHKVYACEVTHQGLSLPVTKSFNRGEC |
| 108 | PRT | S. aureus | HlgA | NSAHHHHHHGSENKIEDIGQAEIIKRTQDIT SKRLAITQNIQFDFVKDKKYNKDALVVKMQ GFISSRTTYSDLKKYPYIKRMIWPFQYNISLKT KDSNVDLINYLPKNKIDSADVSQKLGYNIGG NFQSAPSIGGSGSFNYSKTISYNQKNYVTEVE SQNSKGVKWGVKANSFVTPNGQVSAYDQYL FAQDPTGPAARDYFVPDNQLPPLIQSGFNPSFI TTLSHERGKGDKSEFEITYGRNMDATYAYVT RHRLAVDRKHDAFKNRNVTVKYEVNWKTH EVKIKSITPK |
| 109 | PRT | S. aureus | HlgB | NSAHHHHHHGSEGKITPVSVKKVDDKVTLY KTTATADSDKFKISQILTFNFIKDKSYDKDTL VLKATGNINSGFVKPNPNDYDFSKLYWGAK YNVSISSQSNDSVNVVDYAPKNQNEEFQVQN TLGYTFGGDISISNGLSGGLNGNTAFSETINY KQESYRTTLSRNTNYKNVGWGVEAHKIMNN GWGPYGRDSFHPTYGNELFLAGRQSSAYAG QNFIAQHQMPLLRSNFNPEFLSVLSHRQDG AKKSKITVTYQREMDLYQIRWNGFYWAGAN YKNFKTRTFKSTYEIDWENHKVKLLDTKETE NNK |
| 110 | PRT | S. aureus | HlgC | NSAHHHHHHGSANDTEDIGKGSDIEIIKRTED KTSNKWGVTQNIQFDFVKDKKYNKDALILK MQGFISSRTTYYNYKKTNHVKAMRWPFQYN IGLKTNDKYVSLINYLPKNKIESTNVSQTLGY NIGGNFQSAPSLGGNGSFNYSKSISYTQQNYV SEVEQQNSKSVLWGVKANSFATESGQKSAF DSDLFVGYKPHSKDPRDYFVPDSELPPLVQS GFNPSFIATVSHEKGSSDTSEFEITYGRNMDV THAIKRSTHYGNSYLDGHRVHNAFVNRNYT VKYEVNWKTHEIKVKGQN |
| 111 | PRT | S. aureus | LukF-PV | NSAHHHHHHGSAQHITPVSEKKVDDKITLYK TTATSDSDKLKISQILTFNFIKDKSYDKDTLIL KAAGNIYSGYTKPNPKDTISSQFYWGSKYNIS INSDSNDSVNVVDYAPKNQNEEFQVQQTVG YSYGGDINISNGLSGGGNGSKSFSETINYKQE SYRTSLDKRTNFKKIGWDVEAHKIMNNGWG PYGRDSYHSTYGNEMFLGSRQSNLNAGQNF LEYHKMPVLSRGNFNPEFIGVLSRKQNAAKK SKITVTYQREMDRYTNFWNQLHWIGNNYKD ENRATHTSIYEVDWENHTVKLIDTQSKEKNP MS |
| 112 | PRT | S. aureus | LukS-PV | NSAHHHHHHGSDNNIENIGDGAEVVKRTEDT SSDKWGVTQNIQFDFVKDKKYNKDALILKM QGFINSKTTYYNYKNTDHIKAMRWPFQYNIG LKTNDPNVDLINYLPKNKIDSVNVSQTLGYNI GGNFSGPSTGGNGSFNYSKTISYNQQNYISE VERQNSKVQWGIKANSFITSLGKMSGHDPN LFVGYKPYSQNPRDYFVPDNELPPLVHSGFN PSFIATVSHEKGSGDTSEFEITYGRNMDVTHA TRRTTHYGNSYLEGSRIHNAFVNRNYTVKYE VNWKTHEIKVKGHN |
| 113 | PRT | Artificial | Luk82 LukE, LukF binding FN3 domain | LPAPKNLVVSRVTEDSARLSWSNRAITTFDSF LIQYQESEKVGEAIVLTVPGSERSYDLTGLKP GTEYTVSIYGVEYRFRPKYTGSNPLSAIFTT |

TABLE 6-continued

Nucleic Acid and Amino Acid Sequences of the Disclosure

| SEQ ID NO: | Type | Species | Description | Sequence |
|---|---|---|---|---|
| 114 | PRT | Artificial | Luk83 LukF binding FN3 domain | LPAPKNLVVSRVTEDSARLSWFRPSEDISSFD SFLIQYQESEKVGEAIVLTVPGSERSYDLTGL KPGTEYTVSIYGVAFPTDAKSNPLSAIFTT |
| 115 | PRT | Artificial | Luk85 LukF binding FN3 domain | LPAPKNLVVSRVTEDSARLSWTAPDAAFDSF HINYNEEALVGEAIVLTVPGSERSCDLTGLKP GTEYGVEIEGVKGGPWSWPLSAIFTT |
| 116 | PRT | Artificial | Luk86 LukE, LukF binding FN3 domain | LPAPKNLVVSRVTEDSARLSWTAPDAAFDSF YIRYNEIDLHGEAIVLTVPGSERSYDLTGLKP GTEYQVPIAGVKVCIISKPLSAIFTT |
| 117 | PRT | Artificial | Luk87 LukE binding FN3 domain | LPAPKNLVVSRVTEDSARLSWANTEPSYFAF DSFLIQYQESEKVGEAIVLTVPGSERSYDLTG LKPGTEYTVSIYGVVWVTWGKSNPLSAIFTT |
| 118 | PRT | Artificial | Luk88 LukE binding FN3 domain | LPAPKNLVVSRVTEDSARLSWTLEWSLIFDSF LIQYQESEKVGEAIVLTVPGSERSYDLTGLKP GTEYTVSIYGVQRSVAWYFLLLASNPLSAIFTT |
| 119 | PRT | Artificial | Luk90 LukE binding FN3 domain | LPAPKNLVVSRVTEDSARLSWRTYPTLFDSFL IQYQESEKVGEAIVLTVPGSERSYDLTGLKPG TEYTVSIYGVWPRNIQPWSNPLSAIFTT |
| 120 | PRT | Artificial | Luk92 LukE binding FN3 domain | LPAPKNLVVSRVTEDSARLSWKRVKWVSYQ FDSFLIQYQESEKVGEAIVLTVPGSERSYDLT GLKPGTEYTVSIYGVASIDETVGVSNPLSAIFTT |
| 121 | PRT | Artificial | Luk93 LukE, LukS binding FN3 domain | LPAPKNLVVSRVTEDSARLSWWRRISRFDSF LIQYQESEKVGEAIVLTVPGSERSYDLTGLKP GTEYTVSIYGVDREVYDEWSSNPLSAIFTT |
| 122 | PRT | Artificial | Luk94 LukE binding FN3 domain | LPAPKNLVVSRVTEDSARLSWYRRFLLFIFFD SFLIQYQESEKVGEAIVLTVPGSERSYDLTGL KPGTEYTVSIYGVGEQWGEASDLSNPLSAIFTT |
| 123 | PRT | Artificial | Luk95 LukE binding FN3 domain | LPAPKNLVVSRVTEDSARLSWQHSQYFVLFD SFLIQYQESEKVGEAIVLTVPGSERSYDLTGL KPGTEYTVSIYGVLYRQWRDSNPLSAIFTT |
| 124 | PRT | Artificial | Luk96 LukE binding FN3 domain | LPAPKNLVVSRVTEDSARLSWTAPDAAFDSF LIQYQESEKVGEAIVLTVPGSERSYDLTGLKP GTEYTVSIYGVEHWPSWWHLNFSNPLSAIFTT |
| 125 | PRT | Artificial | Luk97 LukE binding FN3 domain | LPAPKNLVVSRVTEDSARLSWTAPDAAFDSF LIQYQESEKVGEAIVLTVPGSERSYDLTGLKP GTEYTVSIYGVIDIIHINSWNDHSNPLSAIFTT |
| 126 | PRT | Artificial | Luk98 LukE binding FN3 domain | LPAPKNLVVSRVTEDSARLSWNRHSHEFDSF LIQYQESEKVGEAIVLTVPGSERSYDLTGLKP GTEYTVSIYGVRIWVLKLNESNPLSAIFTT |
| 127 | PRT | Artificial | Luk99 LukE binding FN3 domain | LPAPKNLVVSRVTEDSARLSWTAPDAAFDSF EIIYYERHDNGEAIVLTVPGSERSYDLTGLKP GTEYLVWIPGVKGGLTSWPLSAIFTT |
| 128 | PRT | Artificial | Luk100 LukE, LukS binding FN3 domain | LPAPKNLVVSRVTEDSARLSWTAPDAAFDSF PITYGEYRSVGEAIVLTVPGSERSYDLTGLKP GTEYIVDIYGVKGGLFSYPLSAIFTT |
| 129 | PRT | Artificial | Luk101 LukE binding FN3 domain | LPAPKNLVVSRVTEDSARLSWDTEPEWFDSF LIQYQESEKVGEAIVLTVPGSERSYDLTGLKP GTEYTVSIYGVQRVEIRALYRSYSNPLSAIFTT |
| 130 | PRT | Artificial | Luk102 LukE binding FN3 domain | LPAPKNLVVSRVTEDSARLSWTAPDAAFDSF LIQYQESEKVGEAIVLTVPGSERSYDLTGLKP GTEYTVSIYGVSHRFWKHVYFYSNPLSAIFTT |
| 131 | PRT | Artificial | Luk103 LukE binding FN3 domain | LPAPKNLVVSRVTEDSARLSWIIGLSRFDSFLI QYQESEKVGEAIVLTVPGSERSYDLTGLKPG TEYTVSIYGVDFAHQDFFRGYASNPLSAIFTT |

TABLE 6-continued

Nucleic Acid and Amino Acid Sequences of the Disclosure

| SEQ ID NO: | Type | Species | Description | Sequence |
|---|---|---|---|---|
| 132 | PRT | Artificial | Luk104 LukE binding FN3 domain | LPAPKNLVVSRVTEDSARLSWTAPDAAFDSF LIQYQESEKVGEAIVLTVPGSERSYDLTGLKP GTEYTVSIYGVQWWVVAFHHAPSNPLSAIFTT |
| 133 | PRT | Artificial | Luk106 LukE binding FN3 domain | LPAPKNLVVSRVTEDSARLSWTAPDAAFDSF LIQYQESEKVGEAIVLTVPGSERSYDLTGLKP GTEYTVSIYGVVAWIFTKVLNASNPLSAIFTT |
| 134 | PRT | Artificial | Luk107 LukE binding FN3 domain | LPAPKNLVVSRVTEDSARLSWKGPNSPPSQF DSFLIQYQESEKVGEAIVLTVPGSERSYDLTG LKPGTEYTVSIYGVWKWRTRAHSNPLSAIFTT |
| 135 | PRT | Artificial | Luk108 LukE binding FN3 domain | LPAPKNLVVSRVTEDSARLSWFYYYLGKFGF DSFLIQYQESEKVGEAIVLTVPGSERSYDLTG LKPGTEYTVSIYGVVNWRWWPDDSNPLSAIF TT |
| 136 | PRT | Artificial | Luk109 LukE binding FN3 domain | LPAPKNLVVSRVTEDSARLSWTAPDAAFDSF LIQYQESEKVGEAIVLTVPGSERSYDLTGLKP GTEYTVSIYGVIINRFWAWYLASSNPLSAIFTT |
| 137 | PRT | Artificial | Luk110 LukS, LukF binding FN3 domain | LPAPKNLVVSRVTEDSARLSWTAPDAAFDSF LIQYQESEKVGEAIVLTVPGSERSYDLTGLKP GTEYTVSIYGVGFPTFLNYWQFGSNPLSAIFTT |
| 138 | PRT | Artificial | Luk112 HlgA binding FN3 domain | LPAPKNLVVSRVTEDSARLSWTAPDAAFDSF EIHYYEFRHHGEAIVLTVPGSERSYDLTGLKP GTEYAFWIYGVKGGGSSWPLSAIFTT |
| 139 | PRT | Artificial | Luk113 HlgA binding FN3 domain | LPAPKNLVVSRVTEDSARLSWTAPDAAFDSF WIEYHEEYETGEAIVLTVPGSERSYDLTGLKP GTEYWVWIAGVKGGKWSWPLSAIFTT |
| 140 | PRT | Artificial | Luk114 HlgA binding FN3 domain | LPAPKNLVVSRVTEDSARLSWTAPDAAFDSF EIHYQELPQKGEAIVLTVPGSERSYDLTGLKP GTEYVVWIWGVKGGLTSDPLSAIFTT |
| 141 | PRT | Artificial | Luk116 HlgA binding FN3 domain | LPAPKNLVVSRVTEDSARLSWTAPDAAFDSF EIHYQEYPAFGEAIVLTVPGSERSYDLTGLKP GTEYIVWIWGVKGGWTSWPLSAIFTT |
| 142 | PRT | Artificial | Luk117 HlgA binding FN3 domain | LPAPKNLVVSRVTEDSARLSWTAPDAAFDSF EIHYQETISVGEAIVLTVPGSERSYDLTGLKPG TEYWVLIWGVKGGAASDPLSAIFTT |
| 143 | PRT | Artificial | Luk119 HlgA binding FN3 domain | LPAPKNLVVSRVTEDSARLSWTAPDAAFDSF SIDYFEEYQKGEAIVLTVPGSERSYDLTGLKP GTEYWVWIFGVKGGIRSWPLSAIFTT |
| 144 | PRT | Artificial | Luk120 HlgA binding FN3 domain | LPAPKNLVVSRVTEDSARLSWTAPDAAFDSF EINYWEAYIHGEAIVLTVPGSERSYDLTGLKP GTEYWVWIHGVKGGGNSYPLSAIFTT |
| 145 | PRT | Artificial | Luk122 HlgA, LukAB binding FN3 domain | LPAPKNLVVSRVTEDSARLSWTAPDAAFDSF EIHYYEFAIKGEAIVLTVPGSERSYDLTGLKP GTEYAVWIYGVKGGNSSWPLSAIFTT |
| 146 | PRT | Artificial | Luk123 HlgA binding FN3 domain | LPAPKNLVVSRVTEDSARLSWTAPDAAFDSF EIDYFEEYSHGEAIVLTVPGSERSYDLTGLKP GTEYWVWINGVKGGIYSYPLSAIFTT |
| 147 | PRT | Artificial | Luk124 HlgA, LukD binding FN3 domain | LPAPKNLVVSRVTEDSARLSWTAPDAAFDSF TIDYVESYALGEAIVLTVPGSERSYDLTGLKP GTEYWVWIWGVKGGSLSYPMSAIFTT |
| 148 | PRT | Artificial | Luk125 HlgA binding FN3 domain | LPAPKNLVVSRVTEDSARLSWTAPDAAFDSF PIIYYEHHNFGEAIVLTVPGSERSYDLTGLKP GTEYAVPIPGVKGGWQSLPLSAIFTT |
| 149 | PRT | Artificial | Luk126 HlgA binding FN3 domain | LPAPKNLVVSRVTEDSARLSWTAPDAAFDSF YIDYQEWPSVGEAIVLTVPGSERSYDLTGLKP GTEYSVFIHGVKGGWLSKPLSAIFTT |

TABLE 6-continued

Nucleic Acid and Amino Acid Sequences of the Disclosure

| SEQ ID NO: | Type | Species | Description | Sequence |
|---|---|---|---|---|
| 150 | PRT | Artificial | Luk128 HlgA, LukD binding FN3 domain | LPAPKNLVVSRVTEDSARLSWTAPDAAFDSF DIQYFEEYAIGEAIVLTVPGSERSYDLTGLKP GTEYWVWISGVKGGNFSKPLSAIFTT |
| 151 | PRT | Artificial | Luk129 HlgA binding FN3 domain | LPAPKNLVVSRVTEDSARLSWTAPDAAFDSF NINYPEEFHGGEAIVLTVPGSERSYDLTGLKP GTEYEVWIWGVKGGSSSNPLSAIFTT |
| 152 | PRT | Artificial | Luk130 HlgA binding FN3 domain | LPAPKNLVVSRVTEDSARLSWTAPDAAFDSF NIHYLEWEVNGEAIVLTVPGSERSYDLTGLK PGTEYIVEIWGVKGGYSSWPLSAIFTT |
| 153 | PRT | Artificial | Luk132 HlgA binding FN3 domain | LPAPKNLVVSRVTEDSARLSWTAPDAAFDSF YIEYWEWDPVGEAIVLTVPGSERSYDLTGLK PGTEYPVFISGVKGGYPSVPLSAIFTT |
| 154 | PRT | Artificial | Luk133 HlgA binding FN3 domain | LPAPKNLVVSRVTEDSARLSWTAPDAAFDSFI IHYGEGPEFGEAIVLTVPGSERSYDLTGLKPG TEYSVHIPGVKGGWLSWPLSAIFTT |
| 155 | PRT | Artificial | Luk134 HlgA, LukE binding FN3 domain | LPAPKNLVVSRVTEDSARLSWTAPDAAFDSF TIVYLEWVVLGEAIVLTVPGSERSYDLTGLKP GTEYIVDIYGVKGGWTSRPLSAIFTT |
| 156 | PRT | Artificial | Luk136 LukAB, LukD binding FN3 domain | LPAPKNLVVSRVTEDSARLSWTAPDAAFDSF TIDYFEEYVVGEAIVLTVPGSERSYDLTGLKP GTEYWVCIVGVKGGTPSPPLSAIFTT |
| 157 | PRT | Artificial | Luk138 binding FN3 domain | LPAPKNLVVSRVTEDSARLSWTAPDAAFDSF HIWYQEFEVRGEAIVLTVPGSERSYDLTGLKP GTEYDVEIWGVKGGSHSWTLSAIFTT |
| 158 | PRT | Artificial | Luk139 HlgA, LukAB binding FN3 domain | LPAPKNLVVSRVTEDSARLSWTAPDAAFNSF EIHYGEWEYGGEAIVLTVPGSERSYDLTGLK PGTEYTVWIYGVKGGDSSWPLSAIFTT |
| 159 | PRT | Artificial | Luk140 HlgA binding FN3 domain | LPAPKNLVVSRVTEDSARLSWTAPDAAFDSF EIHYQETKKSGEAIVLTVPGSERSYDLTGLKP GTEYWVLIWGVKGGTASNPLSAIFTT |
| 160 | PRT | Artificial | Luk143 HlgA binding FN3 domain | LPAPKNLVVSRVTEDSARLSWTAPDAAFDSF DIQYDERTEEGEAIVLTVPGSERSYDLTGLKP GTEYFVTIPGVKGGWYSWPLSAIFTT |
| 161 | PRT | Artificial | Luk144 HlgA binding FN3 domain | LPAPKNLVVSRVTEDSARLSWTAPDAAFDSF WIDYFEEWVNGEAIVLTVPGSERSYDLTGLK PGTEYWVWIQGVKGGVHSPPLSAIFTT |
| 162 | PRT | Artificial | Luk148 HlgA binding FN3 domain | LPAPKNLVVSRVTEDSARLSWTAPDAAFDSF EIHYQELNRVGEAIVLTVPGSERSYDLTGLKP GTEYWVLIWGVKGGDSSEPLSAIFTT |
| 163 | PRT | Artificial | Luk151 HlgA binding FN3 domain | LPAPKNLVVSRVTEDSARLSWTAPDAAFDSF GITYTEVYWWGEAIVLTVPGSERSYDLTGLK PGTEYTVTIPGVKGGWISAPLSAIFTT |
| 164 | PRT | Artificial | Luk155 HlgA binding FN3 domain | LPAPKNLVVSRVTEDSARLSWTAPDAAFDSF SIRYFEFIKPGEAIWLGVPGSERSYDLTGLKPG TEYHVQIRGVKGGRESYPLWADFTT |
| 165 | PRT | Artificial | Luk156 HlgA binding FN3 domain | LPAPKNLVVSRVTEDSARLSWTAPDAAFDSF EIQYHETRYSGEAIWLWVPGSERSYDLTGLK PGTEYSVYIPGVKGGNVSFPLKAHFTT |
| 166 | PRT | Artificial | Luk158 HlgA binding FN3 domain | LPAPKNLVVSRVTEDSARLSWTAPDAAFDSF AISYKESGRIGEAISLIVPGSERSYDLTGLKPG TEYWVYINGVKGGITSFPLNAWFTT |
| 167 | PRT | Artificial | Luk159 HlgA, LukAB binding FN3 domain | LPAPKNLVVSRVTEDSARLSWTAPDAAFDSF GIDYKETGYTGEAIELEVPGSEHSYDLTGLKP GTEYFVTIGGVKGGYSSWPLVALFTT |

TABLE 6-continued

Nucleic Acid and Amino Acid Sequences of the Disclosure

| SEQ ID NO: | Type | Species | Description | Sequence |
|---|---|---|---|---|
| 168 | PRT | Artificial | Luk160 HlgA binding FN3 domain | LPAPKNLVVSRVTEDSARLSWTAPDAAFDSF VIWYTENPSLGEAIKLSVPGSERSYDLTGLKP GTEYVVEIWGVKGGRGSVPLFAIFTT |
| 169 | PRT | Artificial | Luk163 HlgA binding FN3 domain | LPAPKNLVVSRVTEDSARLSWTAPDAAFDSF YIEYWEPTSDGEAIALNVPGSERSYDLTGLKP GTEYFVEIWGVKGGPRSPPLSAWFTT |
| 170 | PRT | Artificial | Luk164 HlgA binding FN3 domain | LPAPKNLVVSRVTEDSARLSWTAPDAAFDSF DIEYGEPEKIGEAIWLTVPGSERSYDLTGLKP GTEYWVFIYGVKGGALSRPLTATSTT |
| 171 | PRT | Artificial | Luk166 HlgA binding FN3 domain | LPAPKNLVVSRVTEDSARLSWTAPDAAFDSF WIQYFEIQPWGEAILLDVPGSERSYDLTGLKP GTEYSVIIWGVKGGPKSQPLYAWFTT |
| 172 | PRT | Artificial | Luk167 LukD binding FN3 domain | LPAPKNLVVSRVTEDSARLSWTAPDAAFDSF VIIYSEDTIPGEAIVLWVPGSERSYDLTGLKPG TEYYVQIEGVKGGHESFPLVANFTT |
| 173 | PRT | Artificial | Luk174 HlgA binding FN3 domain | LPAPKNLVVSRVTEDSARLSWTAPDAAFDSF DIEYGEPEKIGEAIWLTVPGSERSYDLTGLKP GTEYWVFIYGVKGGALSRPLTATFTT |
| 174 | PRT | Artificial | Luk176 HlgA binding FN3 domain | LPAPKNLVVSRVTEDSARLSWTAPDAAFDSF VIYYHEFPYGGEAIVLTVPGSERSYDLTGLKP GTEYYVRILGVKGGGLSYPLSAIFTT |
| 175 | PRT | Artificial | Luk177 LukD binding FN3 domain | LPAPKNLVVSRVTEDSARLSWTAPDAAFDSF AIYYREWGSGEAIVLTVPGSERSYDLTGLKP GTEYLVITGVKGGNPSYPLSAIFTT |
| 176 | PRT | Artificial | Luk178 HlgA binding FN3 domain | LPAPKNLVVSRVTEDSARLSWTAPDAAFDSF AIHYFEAYAGGEAIVLTVPGSERSYDLTGLKP GTEYWVWIFGVKGGLYSYPLSAIFTT |
| 177 | PRT | Artificial | Luk179 HlgA binding FN3 domain | LPAPKNLVVSRVTEDSARLSWTAPDAAFDSF EINYFEAWDGGEAIVLTVPGSERSYDLTGLKP GTEYWVWISGVKGGRYSYPLSAIFTT |
| 178 | PRT | Artificial | Luk180 HlgA binding FN3 domain | LPAPKNLVVSRVTEDSARLSWTAPDAAFDSF EIHYYEPIYVGEAIVLTVPGSERSYDLTGLKP GTEYIVWIYGVKGGYSSWPLSAIFTT |
| 179 | PRT | Artificial | Luk182 HlgC binding FN3 domain | LPAPKNLVVSRVTEDSARLSWTAPDAAFDSF YILYIENDWQGEAIVLTVPGSERSYDLTGLKP GTEYFVVIHGVKGGWISPPLSAIFTT |
| 180 | PRT | Artificial | Luk183 HlgC binding FN3 domain | LPAPKNLVVSRVTEDSARLSWTAPDAAFDSF TIWYWEFLHNGEAIVLTVPGSERSYDLTGLK PGTEYFVEIYGVKGGSVSVPLSAIFTT |
| 181 | PRT | Artificial | Luk184 HlgC binding FN3 domain | LPAPKNLVVSRVTEDSARLSWTAPDAAFDSF TIIYHELNTAGEAIVLTVPGSERSYDLTGLKP GTEYLVIIHGVKGGPISSPLSAIFTT |
| 182 | PRT | Artificial | Luk185 HlgC, LukS binding FN3 domain | LPAPKNLVVSRVTEDSARLSWTAPDAAFDSF RIVYREWFHYGEAIVLTVPGSERSYDLTGLKP GTEYYVVIHGVKGGYISKPLSAIFTT |
| 183 | PRT | Artificial | Luk186 HlgC binding FN3 domain | LPAPKNLVVSRVTEDSARLSWTAPDAAFDSF HITYTEYSFVGEAIVLTVPGSERSYDLTGLKP GTEYFVEIYGVKGGFISSPLSAIFTT |
| 184 | PRT | Artificial | Luk187 HlgC binding FN3 domain | LPAPKNLVVSRVTEDSARLSWTAPDAAFDSF RILYFEYKRLGEAIVLTVPGSERSYDLTGLKP GTEYFVGIHGVKGGYISRPLSAIFTT |
| 185 | PRT | Artificial | Luk188 HlgC binding FN3 domain | LPAPKNLVVSRVTEDSARLSWTAPDAAFDSF HIHYWEFNPAGEAIVLTVPGSERSYDLTGLKP GTEYFVGIHGVKGGGISWPLSAIFTT |
| 186 | PRT | Artificial | Luk189 HlgC binding FN3 domain | LPAPKNLVVSRVTEDSARLSWTAPDAAFDSL KIFYFEFIYLGEAIVLTVPGSERSYDLTGLKPG TEYHVTIHGVKGGTISLPLSAIFTT |

TABLE 6-continued

Nucleic Acid and Amino Acid Sequences of the Disclosure

| SEQ ID NO: | Type | Species | Description | Sequence |
|---|---|---|---|---|
| 187 | PRT | Artificial | Luk190 HlgC, LukS binding FN3 domain | LPAPKNLVVSRVTEDSARLSWTAPDAAFDSF HIFYYEFSNYGEAIVLTVPGSERSYDLTGLKP GTEYFVIIHGVKGGQISVPLSAIFTT |
| 188 | PRT | Artificial | Luk191 HlgC, LukS binding FN3 domain | LPAPKNLVVSRVTEDSARLSWTAPDAAFDSF TIFYWEWYHGEAIVLTVPGSERSYDLTGLKP GTEYNVVIHGVKGGYISLPLSAIFTT |
| 189 | PRT | Artificial | Luk192 HlgC binding FN3 domain | LPAPKNLDVSRVTEDSARLSWTAPDAAFDSF VIFYYEEKPIGEAIVLTVPGSERSYDLTGLKPG TEYFVEIYGVKGGYISNPLSAIFTT |
| 190 | PRT | Artificial | Luk193 HlgC, LukS binding FN3 domain | LPAPKNLVVSRVTEDSARLSWTAPDAAFDSF NIFYHETRPLGEAIVLTVPGSERSYDLTGLKP GTEYLVAIYGVKGGYISLPLSAIFTT |
| 191 | PRT | Artificial | Luk194 HlgC binding FN3 domain | LPAPKNLVVSRVTEDSARLSWTAPDAAFDSF TIHYWEFSDNGEAIVLTVPGSERSYDLTGLKP GTEYLVGIYGVKGGQISQPLSAIFTT |
| 192 | PRT | Artificial | Luk195 HlgC, LukD binding FN3 domain | LPAPKNLVVSRVTEDSARLSWTAPDAAFDSF HIIYYEYPAGGEAIVLTVPGSERSYDLTGLKP GTEYHVIIHGVKGGFVSVPLSAIFTT |
| 193 | PRT | Artificial | Luk196 HlgC, LukS binding FN3 domain | LPAPKNLVVSRVTEDSARLSWTAPDAAFDSF NIIYIENPYWGEAIVLTVPGSERSYDLTGLKP GTEYFVIIHGVKGGYISEPLSAIFTT |
| 194 | PRT | Artificial | Luk197 HlgC, LukS binding FN3 domain | LPAPKNLVVSRVTEDSARLSWTAPDAAFDSF TILYWEVQANGEAIVLTVPGSERSYDLTGLK PGTEYVVGIYGVKGGYISLPLSAIFTT |
| 195 | PRT | Artificial | Luk198 HlgC, LukS binding FN3 domain | LPAPKNLVVSRVTEDSARLSWTAPDAAFDSF QIFYTEEKTWGEAIVLTVPGSERSYDLTGLK GTEYFVWIHGVKGGWISAPLSAIFTT |
| 196 | PRT | Artificial | Luk199 HlgC, LukS binding FN3 domain | LPAPKNLVVSRVTEDSARLSWTAPDAAFDSF TILYAEHSNKGEAIVLTVPGSERSYDLTGLKP GTEYFVGIYGVKGGFISWPLSAIFTT |
| 197 | PRT | Artificial | Luk201 HlgC, LukS binding FN3 domain | LPAPKNLVVSRVTEDSARLSWTAPDAAFDSF TIFYLEHNDEGEAIVLTVPGSERSYDLTGLKP GTEYWVAIHGVKGGYISQPLSAIFTT |
| 198 | PRT | Artificial | Luk202 HlgC binding FN3 domain | LPAPKNLVVSRVTEDSARLSWTAPDAAFDSF RIWYHETWRGEAIVLTVPGSERSYDLTGLKP GTEYPVVIHGVKGGFISTPLSAIFTT |
| 199 | PRT | Artificial | Luk203 HlgC binding FN3 domain | LPAPKNLVVSRVTEDSARLSWTAPDAAFDSF TIIYVEYETWGEAIVLTVPGSERSYDLTGLKP GTEYIVAIHGVKGGYISIPLSAIFTT |
| 200 | PRT | Artificial | Luk204 HlgC binding FN3 domain | LPAPKNLVVSRVTEDSARLSWTAPDAAFDSF PIIYWELWSIGEAIVLTVPGSERSYDLTGLKPG TEYFVEIYGVKGGTISTPLSAIFTT |
| 201 | PRT | Artificial | Luk205 HlgC binding FN3 domain | LPAPKNLVVSRVTEDSARLSWTAPDAAFDSF SILYWEWVANGEAIVLTVPGSERSYDLTGLK PGTEYFVEIYGVKGGWLSLPLSAIFTT |
| 202 | PRT | Artificial | Luk206 HlgC binding FN3 domain | LPAPKNLVVSRVTEDSARLSWTAPDAAFDSF AIFYFEQFSRGEAIVLTVPGSERSYDLTGLKP GTEYFVAIHGVKGGFVSRPLSAIFTT |
| 203 | PRT | Artificial | Luk208 HlgC binding FN3 domain | LPAPKNLVVSRVTEDSARLSWTAPDAAFDSF TIWYWEWYHLGEAIVLTVPGSELSYDLTGLK PGTEYWVEIYGVKGGFISQPLSAIFTT |
| 204 | PRT | Artificial | Luk210 HlgC, LukS binding FN3 domain | LPAPKNLVVSRVTEDSARLSWTAPDAAFDSF PIFYFEYLGNGEAIVLTVPGSERSYDLTGLKP GTEYFVGIHGVKGGVISTPLSAIFTT |

TABLE 6-continued

Nucleic Acid and Amino Acid Sequences of the Disclosure

| SEQ ID NO: | Type | Species | Description | Sequence |
|---|---|---|---|---|
| 205 | PRT | Artificial | Luk211 HlgC binding FN3 domain | LPAPKNLVVSRVTEDSARLSWTAPDAAFDSF TIIYFEWKRLGEAIVPTVPGSERSYDLTGLKP GTEYWVGIYGVKGGPISVPLSAIFTT |
| 206 | PRT | Artificial | Luk212 HlgC binding FN3 domain | LPAPKNLVVSRVTEDSARLSWTAPDAAFDSF TILYTEREFYGEAIVLTVPGSERSYDLTGLKP GTEYWVGIYGVKGGNISEPLSAIFTT |
| 207 | PRT | Artificial | Luk213 HlgC, LukS binding FN3 domain | LPAPKNLVVSRVTEDSARLSWTAPDAAFDSF HIFYHETDAYGEAIVLTVPGSERSYDLTGLKP GTEYFVVIHGVKGGFISSPLSAIFTT |
| 208 | PRT | Artificial | Luk214 HlgC binding FN3 domain | LPAPKNLVVSRVTEDSARLSWTAPDAAFDSF AIHYWEYDANGEAIVLTVPGSERSYDLTGLK PGTEYLVAIYGVKGGLISVPLSAIFTT |
| 209 | PRT | Artificial | Luk215 HlgC, LukS binding FN3 domain | LPAPKNLVVSRVTEDSARLSWTAPDAAFDSF TILYHESVTNGEAIVLTVPGSERSYDLTGLKP GTEYLVGIYGVKGGYISDPLSAIFTT |
| 210 | PRT | Artificial | Luk216 HlgC, LukS binding FN3 domain | LPAPKNLVVSRVTEDSARLSWTAPDAAFDSF RIHYFEESITGEAIVLTVPGSERSYDLTGLKPG TEYFVAIYGVKGGSISDPLSAIFTT |
| 211 | PRT | Artificial | Luk218 HlgC binding FN3 domain | LPAPKNLVVSRVTEDSARLSWTAPDAAFDSF SIIYWEYRWQGEAIVLTVPGSERSYDLTGLKP GTEYIVPIHGVKGGEISPPLSAIFTT |
| 212 | PRT | Artificial | Luk219 HlgC binding FN3 domain | LPAPKNLVVSRVTEDSARLSWTAPDAAFDSF TIWYWVYRTSGEAIVLTVPGSERSYDLTGLK PGTEYFVAIHGVKGGEISVPLSAIFTT |
| 213 | PRT | Artificial | Luk220 HlgC, LukS binding FN3 domain | LPAPKNLVVSRVTEDSARLSWTAPDAAFDSF AIFYWEESPPGEAIVLTVPGSERSYDLTGLKP GTEYLVAIYGVKGGYISLPLSAIFTT |
| 214 | PRT | Artificial | Luk221 HlgC, LukS, LukD, LukAB binding FN3 domain | LPAPKNLVVSRVTEDSARLSWTAPDAAFDSF AIFYHELEHHGEAIVLTVPGSERSYDLTGLKP GTEYFVAIHGVKGGQISWPLSAIFTT |
| 215 | PRT | Artificial | Luk222 HlgC, LukS binding FN3 domain | LPAPKNLVVSRVTEDSARLSWTAPDAAFDSF SILYWEEEFGEAIVLTVPGSERSYDLTGLKPG TEYFVAIHGVKGGYISRPLSAIFTT |
| 216 | PRT | Artificial | Luk223 HlgC, LukS binding FN3 domain | LPAPKNLVVSRVTEDSARLSWTAPDAAFDSF VILYWEEENQGEAIVLTVPGSERSYDLTGLKP GTEYFVAIHGVKGGHISEPLSAIFTT |
| 217 | PRT | Artificial | Luk224 HlgC, LukS binding FN3 domain | LPAPKNLVVSRVTEDSARLSWTAPDAAFDSF TIFYTEHGVSGEAIVLTVPGSERSYDLTGLKP GTEYWVPIHGVKGGTISQPLSAIFTT |
| 218 | PRT | Artificial | Luk225 HlgC binding FN3 domain | LPAPKNLVVSRVTEDSARLSWTAPDAAFDSF QIFYHEFLTIGEAIVLTVPGSERSYDLTGLKPG TEYIVAIYGVKGGQISDPLSAIFTT |
| 219 | PRT | Artificial | Luk226 HlgC binding FN3 domain | LPAPKNLVVSRVTEDSARLSWTAPDAAFDSF TIHYAEWHLDGEAIVLTVPGSERSYDLTGLK PGTEYFVAIHGVKGGYISEPLSAIFTT |
| 220 | PRT | Artificial | Luk227 HlgC binding FN3 domain | LPAPKNLVVSRVTEDSARLSWTAPDAAFDSF RIYYHEWQATGEAIVLTVPGSERSYDLTGLK PGTEYLVVIHGVKGGWISSPLSAIFTT |
| 221 | PRT | Artificial | Luk228 HlgC, LukS binding FN3 domain | LPAPKNLVVSRVTEDSARLSWTAPDAAFDSF TIPYYEYAVFGEATVLTVPGSERSYDLTGLKP GTEYHVIIHGVKGGYISLPLSAIFTT |
| 222 | PRT | Artificial | Luk229 HlgC, LukS binding FN3 domain | LPAPKNLVVSRVTEDSARLSWTAPDAAFDSF YIFYLEWNQIGEAIVLTVPGSERSYDLTGLKP GTEYFVAIYGVKGGFISDPLSAIFTT |

TABLE 6-continued

Nucleic Acid and Amino Acid Sequences of the Disclosure

| SEQ ID NO: | Type | Species | Description | Sequence |
|---|---|---|---|---|
| 223 | PRT | Artificial | Luk230 HlgC binding FN3 domain | LPAPKNLVVSRVTEDSARLSWTAPDAAFDSFI IFYTESHFYGEAIVLTVPGSERSYDLTGLKPG TEYWVAIYGVKGGEFSFPLSAIFTT |
| 224 | PRT | Artificial | Luk231 HlgC, LukS binding FN3 domain | LPAPKNLVVSRVTEDSARLSWTAPDAAFDSF RILYWEYVTAGEAIVLTVPGSERSYDLTGLKP GTEYFVVIHGVKGGYISIPLSAIFTT |
| 225 | PRT | Artificial | Luk233 HlgC binding FN3 domain | LPAPKNLVVSRVTEDSACLSWTAPDAAFDSF AIQYWEYSGIGEAIVLTVPGSERSYGLTGLKP GTEYFVGIAGVKGGWISLPLSAIFTT |
| 226 | PRT | Artificial | Luk235 HlgC, LukAB binding FN3 domain | LPAPKNLVVSRVTEDSARLSWTAPDAAFDSF SIIYHEWDKNGEAIVLTVPGSERSYDLTGLKP GTEYFVAIYGVKGGYISRPLSAIFTT |
| 227 | PRT | Artificial | Luk236 HlgC, LukS binding FN3 domain | LPAPKNLVVSRVTEDSARLSWTAPDAAFDSF NIFYWEYILPGEAIVLTVPGSERSYDLTGLKP GTEYWVIIHGVKGGHISDPLSAIFTT |
| 228 | PRT | Artificial | Luk237 HlgC binding FN3 domain | MLPPPKNLVVSRVTEDSARLSWTAPDAAFDS FQIIYWEYAETGEAIVLTVPGSERSYDLTGLK PGTEYIVIIHGVKGGEISRPLSAIFTT |
| 229 | PRT | Artificial | Luk238 HlgC, LukS binding FN3 domain | LPAPKNLVVSRVTEDSARLSWTAPDAAFDSF AIFYHETVKSGEAIVLTVPGSERSYDLTGLKP GTEYFVVIHGVKRGQISEPLSAIFTT |
| 230 | PRT | Artificial | Luk239 HlgC binding FN3 domain | LPAPKNLVVSRVTEDSARLSWTAPDAAFDSF HISYWEYAVYGEAIVLTVPGSERSYDLTGLK PGTEYFVGIYGVKGGWISSPLSAIFTT |
| 231 | PRT | Artificial | Luk240 HlgC, LukS binding FN3 domain | LPAPKNLVVSRVTEDSARLSWTAPDAAFDSF PIFYDEEAHNGEAIVLTVPGSERSYDLTGLKP GTEYFVVIHGVKGGTISIPLSAIFTT |
| 232 | PRT | Artificial | Luk241 HlgC, LukS binding FN3 domain | LPAPKNLVVSRVTEDSARLSWTAPDAAFDSF TIYYFESYAVGEAIVLTVPGSERSYDLTGLKP GTEYFVAIYGVKGGWISWPLSAIFTT |
| 233 | PRT | Artificial | Luk242 HlgC, LukS binding FN3 domain | LPAPKNLVVSRVTEDSARLSWTAPDAAFDSF VIFYHETEVDGEAIVLTVPGSERSYDLTGLKP GTEYVVIIHGVKGGFISYPLSAIFTT |
| 234 | PRT | Artificial | Luk243 HlgC binding FN3 domain | LPAPKNLVVSRVTEDSARLSWTAPDAAFDSF QIMYFEFQALGEAIVLTVPGSERSYDLTGLKP GTEYLVLIHGVKGGLISPPLSAIFTT |
| 235 | PRT | Artificial | Luk244 HlgC binding FN3 domain | LPAPKNLVVSRVTEDSARLSWTAPDAAFDSF NIYYWEFLENGEAIVLTVPGSERSYDLTGLKP GTEYFVAIHGVKGGFISWPLSAIFTT |
| 236 | PRT | Artificial | Luk245 HlgC binding FN3 domain | LPAPKNLVVSRVTEDSARLSWTAPDAAFDSF TIHYWEFRPGGEAIVLTVPGSERSYDLTGLKP GTEYFVAIFGVKGGSISVPLSAIFTT |
| 237 | PRT | Artificial | Luk246 HlgC, LukS binding FN3 domain | LPAPKNLVVSRVTEDSARLSWTAPDAAFDSF VIHYFEASPPGEAIVLTVPGSERSYDLTGLKP GTEYYVVIYGVKGGYISPPLSAIFTT |
| 238 | PRT | Artificial | Luk247 HlgC, LukS binding FN3 domain | LPAPKNLVVSRVTEDSARLSWTAPDAAFDSF TIFYHEYVQVGEAIVLTVPGSERSYDLTGLKP GTEYFVAIYGVKGGQISDPLSAIFTT |
| 239 | PRT | Artificial | Luk248 HlgC binding FN3 domain | LPAPKNLVVSRVTEDSARLSWTAPDAAFDSF NIIYWEYVDVGEAIVLTVPGSERSYDLTGLKP GTEYLVPIYGVKGGLISEPLSAIFTT |
| 240 | PRT | Artificial | Luk249 HlgC binding FN3 domain | LPAPKNLVVSRVTEDSARLSWTAPDAAFDSF AIVYWEQKFYGEAIVLTVPGSERSYDLTGLK PGTEYFVGIYGVKGGFISLPLSAIFTT |

TABLE 6-continued

Nucleic Acid and Amino Acid Sequences of the Disclosure

| SEQ ID NO: | Type | Species | Description | Sequence |
|---|---|---|---|---|
| 241 | PRT | Artificial | Luk250 HlgC, LukS binding FN3 domain | LPAPKNLVVSRVTEDSARLSWTAPDAAFDSF VIFYDEWRGVGEAIVLTVPGSERSYDLTGLK PGTEYFVPIQGVKGGYVSDPLSAIFTT |
| 242 | PRT | Artificial | Luk251 HlgC, LukS binding FN3 domain | LPAPKNLVVSRVTEDSARLSWTAPDAAFDSF AIHYHEYQQIGEAIVLTVPGSERSYDLIGLKP GTEYFVAIYGVKGGFISQPLSAIFTT |
| 243 | PRT | Artificial | Luk252 HlgC, LukS binding FN3 domain | LPAPKNLVVSRVTEDSARLSWTAPDAAFDSF AIFYLEWPAKGEAIVLTVPGSERSYDLTGLKP GTEYFVVIHGVKGGWISPPLSAIFTT |
| 244 | PRT | Artificial | Luk253 HlgC binding FN3 domain | LPAPKNLVVSRVTEDSARLSWTAPDAAFDSF NIVYWEYNPVGEAIVLTVPGSERSYDLTGLK PGTEYFVGIYGVKGGNISKPLSAIFTT |
| 245 | PRT | Artificial | Luk254 HlgC, LukS binding FN3 domain | LPAPKNLVVSRVTEDSARLSWTAPDAAFDSF GIFYLEHDWRGEAIVLTVPGSERSYDLTGLKP GTEYLVIIHGVKGGSISVPLSAIFTT |
| 246 | PRT | Artificial | Luk255 HlgC, LukS binding FN3 domain | LPAPKNLVVSRVTEDSARLSWTAPDAAFDSF TILYWEYEQQGEAIVLTVPGSERSYDLTGLKP GTEYFVAIHGVKGGEISQPLSAIFTT |
| 247 | PRT | Artificial | Luk257 LukD, LukAB binding FN3 domain | LPAPKNLVVSRVTEDSARLSWTAPDAAFDSF TIIYIEHVDWGEAIVLTVPGSERSYDLTGLKP GTEYFVEIYGVKGGKISAPLSAIFTT |
| 248 | PRT | Artificial | Luk258 HlgC binding FN3 domain | LPAPKNLVVSRVTEDSARLSWTAPDAAFDSF TIYYFESVDWGEAIVLTVPGSERSYDLTGLKP GTEYYVYIYGVKGGWISVPLSAIFTT |
| 249 | PRT | Artificial | Luk259 HlgC, LukS binding FN3 domain | LPAPKNLVVSRVTEDSARLSWTAPDAAFDSF QIIYWESQYWGEAIVLTVPGSERSYDLTGLKP GTEYIVVIHGVKGGGISDPLSAIFTT |
| 250 | PRT | Artificial | Luk260 HlgC, LukS binding FN3 domain | LPAPKNLVVSRVTEDSARLSWTAPDAAFDSF RIIYYEWESAGEAIVLTVPGSERSYDLTGLKP GTEYFVAIHGVKGGFISFPLSAIFTT |
| 251 | PRT | Artificial | Luk261 HlgC binding FN3 domain | LPAPKNLVVSRVTEDSARLSWTAPDAAFDSF NIFYWEFQKKGEAIVLTVPGSERSYDLTGLKP GTEYIVIIYGVKGGFISPPLSAIFTT |
| 252 | PRT | Artificial | Luk262 HlgC binding FN3 domain | LPAPKNLVVSRVTEDSARLSWTAPDAAFDSF HIFYLEKTNYGEAIVLTVPGSERSYDLTGLKP GTEYLVIIHGVKGGPISGPLSAIFTT |
| 253 | PRT | Artificial | Luk263 HlgC binding FN3 domain | LPAPKNLVVSRVTEDSARLSWTAPDAAFDSF GIWYWEYVRNGEAIVLTVPGSERSYDLTGLK PGTEYFVPIYGVKGGDTSPPLSAIFTT |
| 254 | PRT | Artificial | Luk264 HlgC, LukS binding FN3 domain | LPAPKNLVVSRVTEDSARLSWTAPDAAFDSF VIFYHEYFTVGEAIVLTVPGSERSYDLTGLKP GTEYFVAIHGVKGGLISAPLSAIFTT |
| 255 | PRT | Artificial | Luk265 HlgC binding FN3 domain | LPAPKNLVVSRVTEDSARLSWTAPDAAFDSF QIIYFENEYGGEAIVLTVPGSERSYDLTGLKP GTEYFVAIYGVKGGYLSVPLSAIFTT |
| 256 | PRT | Artificial | Luk266 HlgC binding FN3 domain | LPAPKNLVVSRVTEDSARLSWTAPDAAFDSF RIGYLENPWDGEAIVLTVPGSERSYDLTGLKP GTEYFVFIYGVKGGHISNPLSAIFTT |
| 257 | PRT | Artificial | Luk267 HlgC binding FN3 domain | LPAPKNLVVSRVTEDSARLSWTAPDAAFDSFI IHYFEYEPPGEAIVLTVPGSERSYDLTGLKPG TEYFVGIYGVKGGWVSEPLSAIFTT |
| 258 | PRT | Artificial | Luk268 HlgC, LukS binding FN3 domain | LPAPKNLVVSRVTEDSARLSWTAPDAAFDSF TIFYPEYSARGEAIVLTVPGSERSYDLTGLKP GTEYFVVIHGVKGGFVSEPLSAIFTT |

TABLE 6-continued

Nucleic Acid and Amino Acid Sequences of the Disclosure

| SEQ ID NO: | Type | Species | Description | Sequence |
|---|---|---|---|---|
| 259 | PRT | Artificial | Luk269 HlgC binding FN3 domain | LPAPKNLVVSRVTEDSARLSWTAPDAAFDSF NIIYWEYEVAGEAIVLTVPGSERSYDLTGLKP GTEYFVSIQGVKGGAISPPLSAIFTT |
| 260 | PRT | Artificial | Luk270 HlgC binding FN3 domain | LPAPKNLVVSRVTEDSARLSWTAPDAAFDSF QIVYFEHPSYGEAIVLTVPGSERSYDLTGLKP GTEYFVGIYGVKGGEISAPLSAIFTT |
| 261 | PRT | Artificial | Luk271 HlgC binding FN3 domain | LPAPKNLVVSRVTEDSARLSWTAPDAAFDSF NIVYFEWAANGEAIVLTVPGSERSYDLTGLK PGTEYFVGIYGVKGGAISLPLSAIFTT |
| 262 | PRT | Artificial | Luk272 HlgC, LukS binding FN3 domain | LPAPKNLVVSRVTEDSARLSWTAPDAAFDSF NIFYWEDTLKGEAIVLTVPGSERSYDLTGLKP GTEYVVAIHGVKGGTISHPLSAIFTT |
| 263 | PRT | Artificial | Luk273 HlgC binding FN3 domain | LPAPKNLVVSRVTEDSARLSWTAPDAAFDSF VINYWEFQPAGEAIVLTVPGSERSYDLTGLKP GTEYFVAIHGVKGGQISKPLSAIFTT |
| 264 | PRT | Artificial | Luk274 HlgC, LukS binding FN3 domain | LPAPKNLVVSRVTEDSARLSWTAPDAAFDSF TIIYWELVWNGEAIVLTVPGSERSYDLTGLKP GTEYCVPIHGVKGGLISPPLSAIFTT |
| 265 | PRT | Artificial | Luk275 HlgC, LukS, LukD binding FN3 domain | LPAPKNLVVSRVTEDSARLSWTAPDAAFDSF VIFYEEWQVGGEAIVLTVPGSERSYDLTGLKP GTEYFVAIYGVKGGAISQPLSAIFTT |
| 266 | PRT | Artificial | Luk276 HlgC binding FN3 domain | LPAPKNLVVSRVTEDSARLSWTAPDAAFDSF YIHYFEYEIRGEAIVLTVPGSERSYDLTGLKP GTEYFVSIYGVKGGLISSPLSAIFTT |
| 267 | PRT | Artificial | Luk277 HlgC, LukS binding FN3 domain | LPAPKNLVVSRVTEDSARLSWTAPDAAFDSF TIFYLEYDQGGEAIVLTVPGSERSYDLTGLKP GTEYLVTIHGVKGGYISEPLSAIFTT |
| 268 | PRT | Artificial | Luk278 HlgC, LukS binding FN3 domain | LPAPKNLVVSRVTEDSARLSWTAPDAAFDSF PIFYWEFAVSGEAIVLTVPGSERSYDLTGLKP GTEYSVVIHGVKGGVISEPLSAIFTT |
| 269 | PRT | Artificial | Luk279 HlgC, LukS binding FN3 domain | LPAPKNLVVSRVTEDSARLSWTAPDAAFDSF QIIYFEFFIGGEAIVLTVPGSERSYDLTGLKPG TEYFVVIHGVKGGDLSAPLSAIFTT |
| 270 | PRT | Artificial | Luk280 HlgC, LukS binding FN3 domain | LPAPKNLVVSRVTEDSARLSWTAPDAAFDSF SIIYWEFASNGEAIVLTVPGSERSYDLTGLKP GTEYFVAIYGVKGGEISNPLSAIFTT |
| 271 | PRT | Artificial | Luk281 HlgC, LukS binding FN3 domain | LPAPKNLVVSRVTEDSARLSWTAPDAAFDSF TIFYFEFQTHGEAIVLTVPGSERSYDLTGLKP GTEYFVPITGVKGGWYSDPLSAIFTT |
| 272 | PRT | Artificial | Luk282 HlgC binding FN3 domain | LPAPKNLVVSRVTEDSARLSWTAPDAAFDSFI IIYWEYRTCGEAIVLTVPGSERSYDLTGLKPG TEYFVEIYGVKGGNTSPPLSAIFTT |
| 273 | PRT | Artificial | Luk283 HlgC, LukS binding FN3 domain | LPAPKNLVVSRVTEDSARLSWTAPDAAFDSI TIHYFEPHTGGEAIVLTVPGSERSYDLTGLKP GTEYFVPIYGVKGGYISQPLSAIFTT |
| 274 | PRT | Artificial | Luk285 HlgC, LukS binding FN3 domain | LPAPKNLVVSRVTEDSARLSWTAPDAAFDSF PILYWENITTGEAIVLTVPGSERSYDLTGLKP GTEYFVVIHGVKGGFISGPLSAIFTT |
| 275 | PRT | Artificial | Luk286 HlgC binding FN3 domain | LPAPKNLVVSRVTEDSARLSWTAPDAAFDSF PIFYWEFQAAGEAIVLTVPGSERSYDLTGLKP GTEYFVEIYGVKGGWTSFPLSAIFTT |
| 276 | PRT | Artificial | Luk287 HlgC binding FN3 domain | LPAPKNLVVSRVTEDSARLSWTAPDAAFDSF VIVYWEWQCNGEAIVLTVPGSERSYDLTGLK PGTEYFVPIHGVKGGITSAPLSAIFTT |

TABLE 6-continued

Nucleic Acid and Amino Acid Sequences of the Disclosure

| SEQ ID NO: | Type | Species | Description | Sequence |
|---|---|---|---|---|
| 277 | PRT | Artificial | Luk288 HlgC binding FN3 domain | LPAPKNLVVSRVTEDSARLSWTAPDAAFDSF AIHYWEPQGIGEAIVLTVPGSERSYDLTGLKP GTEYFVGIHGVKGGWISFPLSAIFTT |
| 278 | PRT | Artificial | Luk289 HlgC binding FN3 domain | LPAPKNLVVSRVTEDSARLSWTAPDAAFDSFI IPYWEYQYAGEAIVLTVPGSERSYDLTGLKP GTEYWVGIYGVKGGSISEPLSAIFTT |
| 279 | PRT | Artificial | Luk290 HlgC, LukS binding FN3 domain | LPAPKNLVVSRVTEDSARLSWTAPDAAFDSF TIFYIEPQFEGEAIVLTVPGSERSYDLTGLKPG TEYIVVIHGVKGGYISKPLSAIFTT |
| 280 | PRT | Artificial | Luk291 HlgC, LukS binding FN3 domain | LPAPKNLVVSRVTEDSARLSWTAPDAAFDSF NIIYWEYDPHGEAIVLTVPGSERSYDLTGLKP GTEYIVSIYGVKGGYISPPLSAIFTT |
| 281 | PRT | Artificial | Luk292 HlgC binding FN3 domain | LPAPKNLVVSRVTEDSARLSWTAPDAAFDSF AIEYWEWIDKGEAIVLTVPGSERSYDLTGLKP GTEYFVGIYGVKGGYISWPLSAIFTT |
| 282 | PRT | Artificial | Luk293 HlgC, LukS, LukD, LukAB binding FN3 domain | LPAPKNLVVSRVTEDSARLSWTAPDAAFDSF SILYHEWSGWGEAIVLTVPGSERSYDLTGLK PGTEYFVFIHGVKGGYISPPLSAIFTT |
| 283 | PRT | Artificial | Luk294 HlgC, LukS binding FN3 domain | LPAPKNLVVSRVTEDSARLSWTAPDAAFDSF QILYWETAKSGEAIVLTVPGSERSYDLTGLKP GTEYFVEIYGVKGGWISWPLSAIFTT |
| 284 | PRT | Artificial | Luk296 HlgC binding FN3 domain | LPAPKNLVVSRVTEDSARLSWTAPDAAFDSF TIHYYEFKYQGEAIVLTVPGSERSYDLTGLKP GTEYFVVIHGVKGGFISPPLSAIFTT |
| 285 | PRT | Artificial | Luk298 HlgC, LukS binding FN3 domain | LPAPKNLVVSRVTEDSARLSWTAPDAAFDSF TIIYLEGNWSGEAIVLTVPGSERSYDLTGLKP GTEYFVSIYGVKGGFISEPLSAIFTT |
| 286 | PRT | Artificial | Luk299 HlgC, LukS, LukAB binding FN3 domain | LPAPKNLVVSRVTEDSARLSWTAPDAAFDSF KIFYWEWPHSGEAIVLTVPGSERSYDLTGLKP GTEYFVAIHGVKGGWISKPLSAIFTT |
| 287 | PRT | Artificial | Luk300 HlgC binding FN3 domain | LPAPKNLVVSRVTEDSARLSWTAPDAAFDSF TISYWEYAGYGEAIVLTVPGSERSYDLTGLKP GTEYFVGIHGVKGGWISKPLSAIFTT |
| 288 | PRT | Artificial | Luk301 HlgC binding FN3 domain | LPAPKNLVVSRVTEDSARLSWTAPDAAFDSF HISYWEYYARGEAIVLTVPGSERSYDLTGLK PGTEYFVGIYGVKGGVISPPLSAIFTT |
| 289 | PRT | Artificial | Luk302 HlgC, LukS binding FN3 domain | LPAPKNLVVSRVTEDSARLSWTAPDAAFDSF KIWYLETGFRGEAIVLTVPGSERSYDLTGLKP GTEYFVPIYGVKGGYISQPLSAIFTT |
| 290 | PRT | Artificial | Luk303 HlgC binding FN3 domain | LPAPKNLVVSRVTEDSARLSWTAPDAAFDSF NIQYWEWNLGGEAIVLTVPGSERSYDLTGLK PGTEYFVAIYGVKGGAISDPLSAIFTT |
| 291 | PRT | Artificial | Luk304 HlgC binding FN3 domain | LPAPKNLVVSRVTEDSARLSWTAPDAAFDSF WIGYTELYEFGEAISLLVPGSERSYDLTGLKP GTEYSVAIAGVKGGAYSHPLHALFTT |
| 292 | PRT | Artificial | Luk305 HlgC binding FN3 domain | LPAPKNLVVSRVTEDSARLSWTAPDAAFDSF YIKYAEHVVWGEAIDLLVPGSERSYDLTGLK PGTEYEVGIAGVKGGTVSVPLSARFTT |
| 293 | PRT | Artificial | Luk306 HlgC, LukS binding FN3 domain | LPAPKNLVVSRVTEDSARLSWTAPDAAFDSFI ILYDEIWPSGEAISLGVPGSERSYDLTGLKPGT EYFVAIHGVKGGNISDPLDAKFTT |
| 294 | PRT | Artificial | Luk307 HlgC, LukS binding FN3 domain | LPAPKNLVVSRVTEDSARLSWTAPDAAFDSF WIGYTESRYYGEAIDLLVPGSERSYDLTGLKP GTEYHVRISGVKGGAFSTPLWAAATT |

TABLE 6-continued

Nucleic Acid and Amino Acid Sequences of the Disclosure

| SEQ ID NO: | Type | Species | Description | Sequence |
|---|---|---|---|---|
| 295 | PRT | Artificial | Luk308 HlgC binding FN3 domain | LPAPKNLVVSRVTEDSARLSWTAPDAAFDSF WIGYGERLRFGEAIDLLVPGSERSYDLTGLKP GTEYHVGISGVKGGWFSNPLRAIFTT |
| 296 | PRT | Artificial | Luk309 HlgC binding FN3 domain | LPAPKNLVVSRVTEDSARLSWTAPDAAFDSF KIFYLESDWEGEAIALWVPGSERSYDLTGLK PGTEYFVFIHGVKGGYISIPLHANFTT |
| 297 | PRT | Artificial | Luk310 HlgC, LukS binding FN3 domain | LPAPKNLVVSRVTEDSARLSWTAPDAAFDSF WIGYTETAKWGEAITLLVPGSERSYDLTGLK PGTEYRVGIGGVKGGGWSWPLDAIFTT |
| 298 | PRT | Artificial | Luk311 HlgC binding FN3 domain | LPAPKNLVVSRVTEDSARLSWTAPDAAFDSF WISYVEPDDGEAIELLVPGSERSYDLTGLKPG TEYIVQIDGVKGGTTSVPLNARFTT |
| 299 | PRT | Artificial | Luk312 HlgC binding FN3 domain | LPAPKNLVVSRVTEDSARLSWTAPDAAFDSF WIGYSEYPEYGEAIDLVVPGSERSYDLTGLKP GTEYRVGITGVKGGWISKPLNATFTT |
| 300 | PRT | Artificial | Luk313 HlgC, LukS binding FN3 domain | LPAPKNLVVSRVTEDSARLSWTAPDAAFDSF WIGYNEIGKWGEAIDLIVPGSERSYDLTGLKP GTEYAVGIDGVKGGSISEPLPASFTT |
| 301 | PRT | Artificial | Luk314 HlgC binding FN3 domain | LPAPKNLVVSRVTEDSARLSWTAPDAAFDSF AIFYTEFNFKGEAIPLDVPGSERSYDLTGLKP GTEYFVSIHGVKGGEISPPLEALFTT |
| 302 | PRT | Artificial | Luk315 HlgC binding FN3 domain | LPAPKNLVVSRVTEDSARLSWTAPDAAFDSF WISYQEPDEIGEAIELIVPGSERSYDLTGLKPG TEYFVQIDGVKGGTWSIPLNAYFTT |
| 303 | PRT | Artificial | Luk317 HlgC, LukS binding FN3 domain | LPAPKNLVVSRVTEDSARLSWTAPDAAFDSF WIGYHEFPTWGEAIDLLVPGSERSYDLTGLK PGTEYQVRISGVKGGTTSQPLQAAAT |
| 304 | PRT | Artificial | Luk318 HlgC, LukS, HlgA binding FN3 domain | LPAPKNLVVSRVTEDSARLSWTAPDAAFDSF WIGYHETVGFGEAIALLVPGSERSYDLTGLKP GTEYAVAIDGVKGGWFSHPLVAYFTT |
| 305 | PRT | Artificial | Luk319 HlgC, LukS binding FN3 domain | LPAPKNLVVSRVTEDSARLSWTAPDAAFDSF WIGYFERFNWGEAIDLLVPGSERSYDLTGLK PGTEYQVQIDGVKGGDISIPLSARFTT |
| 306 | PRT | Artificial | Luk320 HlgC, LukS binding FN3 domain | LPAPKNLVVSRVTEDSARLSWTAPDAAFDSF WIGYSEWEQLGEAIDLIVPGSERSYDLTGLKP GTEYQVGIAGVKGGSSSFPLGAEFTT |
| 307 | PRT | Artificial | Luk321 HlgC binding FN3 domain | LPAPKNLVVSRVTEDSARLSWTAPDAAFDSF WIGYQEAATWGEAIDLSVPGSERSYDLTGLK PGTEYHVGIVGVKGGGVSTPLVAPFTT |
| 308 | PRT | Artificial | Luk322 HlgC, LukS binding FN3 domain | LPAPKNLVVSRVTEDSARLSWTAPDAAFDSF WIGYYESHRGGEAIDLLVPGSERSYDLTGLK PGTEYTVGITGVKGGTISYPLHAIFTT |
| 309 | PRT | Artificial | Luk323 HlgC binding FN3 domain | LPAPKNLVVSRVTEDSARLSWTEPDAAFDSF WIAYPEPGFQGEAISLLVPGSERSYDLTGLKP GTEYEVQIAGVKGGHVSWPLVATFTT |
| 310 | PRT | Artificial | Luk324 HlgC, LukS binding FN3 domain | LPAPKNLVVSRVTEDSARLSWTAPDAAFDSF WIAYEEVRAEGEAIELLVPGSERSYDLTGLKP GTEYVVGIDGVKGGGFSSPLVAHFTT |
| 311 | PRT | Artificial | Luk326 HlgC binding FN3 domain | LPAPKNLVVSRVTEDSARLSWTAPDAAFDSF WIAYYERTQQGEAIELLVPGSERSYDLTGLKP GTEYWVGIDGVKGGEVSQPLKAHFTT |
| 312 | PRT | Artificial | Luk327 HlgC binding FN3 domain | LPAPKNLVVSRVTEDSARLSWTAPDAAFDSF AIFYLEWLYHGEAIKLYVPGSERSYDLTGLKP GTEYYVVIHGVKGGFVSTPLFATFTT |

TABLE 6-continued

Nucleic Acid and Amino Acid Sequences of the Disclosure

| SEQ ID NO: | Type | Species | Description | Sequence |
|---|---|---|---|---|
| 313 | PRT | Artificial | Luk329 HlgC, LukF binding FN3 domain | LPAPKNLVVSRVTEDSARLSWTAPDAAFDSF WIGYWEGIGYGEAITLLVPGSERSYDLTGLKP GTEYNVGIDGVKGGDFSTPLWARFTT |
| 314 | PRT | Artificial | Luk330 HlgC, LukS binding FN3 domain | LPAPKNLVVSRVTEDSARLSWTAPDAAFDSF WIGYHEFSTYGEAIDLLVPGSERSYDLTGLKP GTEYTVKIAGVKGGATSVPLVATFTT |
| 315 | PRT | Artificial | Luk331 HlgC, LukS, LukD binding FN3 domain | LPAPKNLVVSRVTEDSARLSWTAPDAAFDSF AIFYFEDDERGEAIVLNVPGSERSYDLTGLKP GTEYHVIIHGVKGGQISSPLYATFTT |
| 316 | PRT | Artificial | Luk332 HlgC, LukS, LukAB binding FN3 domain | LPAPKNLVVSRVTEDSARLSWTAPDAAFDSF WIAYGEWEYPGEAIELLVPGSERSYDLTGLK PGTEYHVGIDGVKGGRVSYPLRAQFTT |
| 317 | PRT | Artificial | Luk333 HlgC binding FN3 domain | LPAPKNLVVSRVTEDSARLSWTAPDAAFDSF RIHYWEGLFVGEAIVLSVPGSERSYDLTGLKP GTEYAVPIYGVKGGSISKPLYALFTT |
| 318 | PRT | Artificial | Luk334 HlgC binding FN3 domain | LPAPKNLVVSRVTEDSARLSWTAPDAAFDSF HIGYHEAEGFGEAIALLVPGSERSYDLTGLKP GTEYPVGISGVKGGFVSFPLWARFTT |
| 319 | PRT | Artificial | Luk335 HlgC, LukS binding FN3 domain | LPAPKNLVVSRVTEDSARLSWTAPDAAFDSF WIGYNEIVNHGEAIDLVVPGSERSYDLTGLKP GTEYRVSIGGVKGGHWSVPLWARFTT |
| 320 | PRT | Artificial | Luk336 HlgC, LukS binding FN3 domain | LPAPKNLVVSRVTEDSARLSWTAPDAAFDSF WIGYHEWIGPGEAISLLVPGSERSYDLTGLKP GTEYWVGIAGVKGGWSSRPLSATFTT |
| 321 | PRT | Artificial | Luk337 HlgC, LukS binding FN3 domain | LPAPKNLVVSRVTEDSARLSWTAPDAAFDSF WIGYEEPLYFGEAIDLLVPGSERSYDLTGLKP GTEYRVHIGGVKGGRVSIPLEAEFTT |
| 322 | PRT | Artificial | Luk338 HlgC, LukS binding FN3 domain | LPAPKNLVVSRVTEDSARLSWTAPDAAFDSF WIAYEEDNAQGEAIELLVPGSERSYDLTGLK PGTEYDVKIDGVKGGRVSTPLVARFTT |
| 323 | PRT | Artificial | Luk339 HlgC binding FN3 domain | LPAPKNLVVSRVTEDSARLSWTAPDAAFDSF VIFYWEGQWNGEAILLDVPGSERSYDLTGLK PGTEYIVPIHGVKGGWISLPLVATFTT |
| 324 | PRT | Artificial | Luk340 HlgC, LukS binding FN3 domain | LPAPKNLVVSRVTEDSARLSWTAPDAAFDSF WIGYHESPYAGEAIDLVVPGSERSYDLTGLK PGTEYAVGIAGVKGGGYSIPLRAIFTT |
| 325 | PRT | Artificial | Luk342 HlgC, LukS binding FN3 domain | LPAPKNLVVSRVTEDSARLSWTAPDAAFDSF WIGYSEPTIYGEAIDLLVPGSERSYDLTGLKP GTEYFVGITGVKGGWNSRPLSAIFTT |
| 326 | PRT | Artificial | Luk343 HlgC binding FN3 domain | LPAPKNLVVSRVTEDSARLSWTAPDAAFDSF AIFYTETHWFGEAINLPVPGSERSYDLTGLKP GTEYGVIIHGVKGGYISDPLWAAFTT |
| 327 | PRT | Artificial | Luk344 HlgC, LukS binding FN3 domain | LPAPKNLVVSRVTEDSARLSWTAPDAAFDSF WISYVEPVFSGEAIELLVPGSERSYDLTGLKP GTEYIVGIGGVKGGGWSIPLEAHFTT |
| 328 | PRT | Artificial | Luk345 HlgC binding FN3 domain | LPAPKNLVVSRVTEDSARLSWTAPDAAFDSF SIFYIEAKFRGEAIRLGVPGSERSYDLTGLKPG TEYFVWIHGVKGGEISDPLEAPFTT |
| 329 | PRT | Artificial | Luk346 HlgC, LukS binding FN3 domain | LPAPKNLVVSRVTEDSARLSWTAPDAAFDSF WIAYYEIVGWGEAITLLVPGSERSYDLTGLKP GTKYVVLIDGVKGGLLSQPLHAEFAT |
| 330 | PRT | Artificial | Luk347 HlgC, LukS binding FN3 domain | LPAPKNLVVSRVTEDSARLSWTAPDAAFDSF WIGYHETTRFGEAIDLLVPGSERSYDLTGLKP GTEYVVAIQGVKGGHVSQPLRAPFTT |

TABLE 6-continued

Nucleic Acid and Amino Acid Sequences of the Disclosure

| SEQ ID NO: | Type | Species | Description | Sequence |
|---|---|---|---|---|
| 331 | PRT | Artificial | Luk348 HlgC binding FN3 domain | LPAPKNLVVSRVTEDSARLSWTAPDAAFDSF SIIYLEASFRGEAIVLTVPGSERSYDLTGLKPG TEYFVSIYGVKGGHFSPPLDAIFTT |
| 332 | PRT | Artificial | Luk349 HlgC binding FN3 domain | LPAPKNLVVSRVTEDSARLSWTAPDAAFDSF WIGYREWIQWGEAISLLVPGSERSYDLTGLK PGTEYRVGITGVNGGVTSVPLHAKFTT |
| 333 | PRT | Artificial | Luk350 HlgC, LukF binding FN3 domain | LPAPKNLVVSRVTEDSARLSWTAPDAAFDSF WIAYHEGLSWGEAIDLLVPGSERSYDLTGLK PGTEYTVSIDGVKGGYTSEPLRASFTT |
| 334 | PRT | Artificial | Luk351 HlgC, LukS binding FN3 domain | LPAPKNLVVSRVTEDSARLSWTAPDAAFDSF WIGYDETLTYGEAITLLVPGSERSYDLTGLKP GTEYTVGIDGVKGGRNSVPLKATFTT |
| 335 | PRT | Artificial | Luk353 HlgC, LukS binding FN3 domain | LPAPKNLVVSRVTEDSARLSWTAPDAAFDSF WIGYHEPRAWGEAIDLLVPGSERSYDLTGLK PGTEYLVGIGGVKGGKQSKPLVAKFTT |
| 336 | PRT | Artificial | Luk354 HlgC, LukS binding FN3 domain | LPAPKNLVVSRVTEDSARLSWTAPDAAFDSF WIGYTEQKNHGEAIDLLVPGSERSYDLTGLK PGTEYEVNIAGVKGGGWSIPLNAWFTT |
| 337 | PRT | Artificial | Luk355 HlgC binding FN3 domain | LPAPKNLVVSRVTEDSARLSWTAPDAAFDSF KIVYVEIHYRGEAIHLSVPGSERSYDLTGLKP GTEYHVVIHGVKGGGISLPLDAPFTT |
| 338 | PRT | Artificial | Luk356 HlgC, LukS binding FN3 domain | LPAPKNLVVSRVTEDSARLSWTAPDATFDSF WIGYSEDQRTGEAIDLVVPGSERSYDLTGLK PGTEYRVAIAGVKGGYISQPLSANFTT |
| 339 | PRT | Artificial | Luk357 HlgC binding FN3 domain | LPAPKNLVVSRVTEDSARLSWTAPDAAFDSF TIHYFESLLTGEAISLVVPGSERSYDLTGLKPG TEYLVPIYGVKGGFISQPLIAIFTT |
| 340 | PRT | Artificial | Luk358 HlgC, LukS binding FN3 domain | LPAPKNLVVSRVTEDSARLSWTAPDAAFDSF AINYYEYYPAGEAIVLTVPGSERSYDLTGLKP GTEYFVAIYGVKGGYISPPLSAIFTT |
| 341 | PRT | Artificial | Luk361 HlgC binding FN3 domain | LPAPKNLVVSRVTEDSARLSWTAPDAAFDSF SIYYYEYYANGEAIVLTVPGSERSYDLTGLKP GTEYFVAIYGVKGGYVSDPLSAIFTT |
| 342 | PRT | Artificial | Luk362 HlgC binding FN3 domain | LPAPKNLVVSRVTEDSARLSWTAPDAAFDSF PIYYLEYSFTGEAIVLTVPGSERSYDLTGLKP GTEYAVYIYGVKGGWISDPLSAIFTT |
| 343 | PRT | Artificial | Luk363 HlgC binding FN3 domain | LPAPKNLVVSRVTEDSARLSWTAPDAAFDSF RIYYYEWASYGEAIVLTVPGSERSYDLTGLK PGTEYFVGIYGVKGGHISRPLSAIFTT |
| 344 | PRT | Artificial | Luk364 HlgC binding FN3 domain | LPAPKNLVVSRVTEDSARLSWTAPDAAFDSF RIFYHEYSYRGEAIVLTVPGSERSYDLTGLKP GTEYLVIIHSVKGGSVSSPLSAIFTT |
| 345 | PRT | Artificial | Luk365 HlgC, LukS binding FN3 domain | LPAPKNLVVSRVTEDSARLSWTAPDAAFDSF TIYYYEYWYGGEAIVLTVPGSERSYDLTGLK PGTEYWVGIYGVKGGYISSPLSAIFTT |
| 346 | PRT | Artificial | Luk366 HlgC, LukS binding FN3 domain | LPAPKNLVVSRVTEDSARLSWTAPDAAFDSF AIFYYEFNWGGEAIVLTVPGSERSYDLTGLK PGTEYWVGIYGVKGGYISYPLSAIFTT |
| 347 | PRT | Artificial | Luk368 HlgC binding FN3 domain | LPAPKNLVVSRVTEDSARLSWTAPDAAFDSF AIYYFESINLGDAIVLTVPGSERSYDLTGLKP GTEYYVYIYGVKGGYISYPLSAIFTT |
| 348 | PRT | Artificial | Luk369 HlgC binding FN3 domain | LPAPKNLVVSRVTEDSARLSWTAPDAAFDSF RIFYYEYGGGEAIVLTVPGSERSYDLTGLKP GTEYHVGIYGVKGGYISPPLSAIFTT |
| 349 | PRT | Artificial | Luk370 HlgC binding FN3 domain | LPAPKNLVVSRVTEDSARLSWTAPDAAFDSF SIYYFEYWTYGEAIVLTVPGSERSYDLTGLKP GTEYYVYIYGVKGGYISDPLSAIFTT |

TABLE 6-continued

Nucleic Acid and Amino Acid Sequences of the Disclosure

| SEQ ID NO: | Type | Species | Description | Sequence |
|---|---|---|---|---|
| 350 | PRT | Artificial | Luk371 HlgC binding FN3 domain | LPAPKNLVVSRVIEDSARLSWTAPDAAFDSFT IFYYEYDSGEAIVLTVPGSERSYDLTGLKPGT EYTVAIFGVKGGYISAPLSAIFTT |
| 351 | PRT | Artificial | Luk372 HlgC, LukS binding FN3 domain | LPAPKNLVVSRVTEDSARLSWTAPDAAFDSF LIGYEEYANAGEAIVLTVPGSERSYDLTGLKP GTEYLVFIYGVKGGYYSPLSAIFTT |
| 352 | PRT | Artificial | Luk373 HlgC binding FN3 domain | LPAPKNLVVSRVTEDSARLSWTAPDAAFDSF HIYYFEYINLGEAIVLTVPGSERSYDLTGLKP GTEYFVYIHGVKGGFVSDPLSAIFTT |
| 353 | PRT | Artificial | Luk374 HlgC binding FN3 domain | LPAPKNLVVSRVTEDSARLSWTAPDAAFDSF VIEYWEYRLAGEAIVLTVPGSERSYDLTGLKP GTEYFVGIYGVKGGAVSLPLSAIFTT |
| 354 | PRT | Artificial | Luk375 HlgC binding FN3 domain | LPAPKNLVVSRVTEDSARLSWTAPDAAFDSF HIDYWEYVFLGEAIVLTVPGSERSYDLTGLKP GTEYFVSITGVKGGRYSPLSAIFTT |
| 355 | PRT | Artificial | Luk376 HlgC, LukS binding FN3 domain | LPAPKNLVVSRVTEDSARLSWTAPDAAFDSF TIPYYEYWWSGEAIVLTVPGSERSYDLTGLK PGTEYWVGIYGVKGGYISSPLSAIFTT |
| 356 | PRT | Artificial | Luk377 HlgC binding FN3 domain | LPAPKNLVVSRVTEDSARLSWTAPDAAFDSF WINYWEYYPHGEAIVLTVPGSERSYDLTGLK PGTEYFVGIYGVKGGSYSHPLSAIFTT |
| 357 | PRT | Artificial | Luk378 HlgC, LukS binding FN3 domain | LPAPKNLVVSRVTEDSARLSWTAPDAAFDSF AIFYHEDAYTGEAIVLTVPGSERSYDLTGLKP GTEYFVVIHGVKGGFLSRPLSAIFTT |
| 358 | PRT | Artificial | Luk379 HlgC binding FN3 domain | LPAPKNLVVSRVTEDSARLSWTAPDAAFDSF YILYHEYEYSGEAIVLTVPGSERSYDLTGLKP GTEYFVAIYGVKGGLYSAPLSAIFTT |
| 359 | PRT | Artificial | Luk380 HlgC, LukS binding FN3 domain | LPAPKNLVVSRVNEDSARLSWTAPDAAFDSF DIVYGVGEAIVLTVPGSERSYDLTGLKPGTEY YVPIAGVKGGGVSWPLSAIFTT |
| 360 | PRT | Artificial | Luk381 HlgC, LukS binding FN3 domain | LPAPKNLVVSRVTEDSARLSWTAPDAAFDSF RIYYYEYYKYGEAIVLTVPGSERSYDLTGLKP GTEYFVAIYGVKGGEISDPLSAIFTT |
| 361 | PRT | Artificial | Luk382 HlgC binding FN3 domain | LPAPKNLVVSRVTEDSARLSWTAPDAAFDSF GIIYDETAQYGEAIVLTVPGSERSYDLTGLKP GTEYLVPIHGVKGGTISYPLSAIFTT |
| 362 | PRT | Artificial | Luk390 LukD binding FN3 domain | LPAPKNLVVSRVTEDSARLSWTYIHHGFDSF LIQYQESEKVGEAIVLTVPGSERSYDLTGLKP GTEYTVSIYGVVWGYWNPTQYSNPLSAIFTT |
| 363 | PRT | Artificial | Luk394 LukE binding FN3 domain | LPAPKNLVVSRVTEDSARLSWDQYRLNFDSF LIQYQESEKVGEAIVLTVPGSERSYDLTGLKP GTEYTVSIYGVNWGYFLAPEISNPLSAIFTT |
| 364 | PRT | Artificial | Luk399 LukE binding FN3 domain | LPAPKNLVVSRVTEDSARLSWPGQTRKFNIF DSFLIQYQESEKVGEAIVLTVPGSERSYDLTG LKPGTEYTVSIYGVVGIFLTFGSNPLSAIFTT |
| 365 | PRT | Artificial | Luk409 LukD binding FN3 domain | LPAPKNLVVSRVTEDSARLSWKYTLYQHYF DSFLIQYQESEKVGEAIVLTVPGSERSYDLTG LKPGTEYTVSIYGVLAWWSFGSNPLSAIFTT |
| 366 | PRT | Artificial | Luk412 LukE binding FN3 domain | LPAPKNLVVSRVTEDSARLSWTAPDAAFDSF GIGYLEYPWYGEAIVLTVPGSERSYDLTGLKP GTEYFVDIYGVKGGWWSYPLSAIFTT |
| 367 | PRT | Artificial | Luk414 LukE binding FN3 domain | LPAPNLLVVSRVTEDSARLSWTAPDAAFDSF WIDYIETYYYGEAIVLTVPGSERSYDLTGLKP GTEYLVDIYGVKGGWYSLPLSAIFTT |

TABLE 6-continued

Nucleic Acid and Amino Acid Sequences of the Disclosure

| SEQ ID NO: | Type | Species | Description | Sequence |
|---|---|---|---|---|
| 368 | PRT | Artificial | Luk415 LukE binding FN3 domain | LPAPKNLVVSRVTEDSARLSWTAPDAAFDSF EISYTEYGISGEAIVLTVPGSERSYDLTGLKPG TEYFVDIYGVKGGYLSYPLSAIFTT |
| 369 | PRT | Artificial | Luk417 LukE binding FN3 domain | LPAPKNLVVSRVTEDSARLSWTAPDAAFDSF NIDYFEYYEFGEAIVLTVPGSERSYDLTGLKP GTEYFVDIYGVKGGSWSLPLSAIFTT |
| 370 | PRT | Artificial | Luk420 LukAB binding FN3 domain | LPAPKNLVVSRVTEDSARLSWWLGRFNFDSF LIQYQESEKVGEAIVLTVPGSERSYDLTGLKP GTEYTVSIYGVKQWIISEESLSNPLSAIFTT |
| 371 | PRT | Artificial | Luk428 LukF binding FN3 domain | LPAPKNLVVSRVTEDSARLSWGIKEETIIFDSF LIQYQESEKVGEAIVLTVPGSERSYDLTGLKP GTEYTVSIYGVNIIELHLWSNPLSAIFTT |
| 372 | PRT | Artificial | Luk438 HlgC binding FN3 domain | LPAPKNLVVSRVTEDSARLSWWRKPKRWRH FDSFLIQYQESEKVGEAIVLTVPGSERSYDLT GLKPGTEYTVSIYGVAPDTPTPVIISNPLSAIFTT |
| 373 | PRT | Artificial | Luk445 HlgA binding FN3 domain | LPAPKNLVVSRVTEDSARLSWEVNTKTSNKF DSFLIQYQESEKVGEAIVLTVPGSERSYDLTG LKPGTEYTVSIYGVGYWLTNVVLASNPLSAIF TT |
| 374 | PRT | Artificial | Luk447 LukD binding FN3 domain | LPAPKNLVVSRVTEDSARLSWGIDDYFVHFF DSFLIQYQESEKVGEAIVLTVPGSERSYDLTG LKPGTEYTVSIYGVSIHFEFTTYSRSNPLSAIFTT |
| 375 | PRT | Artificial | Luk449 LukE, HlgA binding FN3 domain | LPAPKNLVVSRVTEDSARLSWTAPDAAFDSF DISYDEYPEFGEAIVLTVPGSERSYDLTGLKP GTEYLVDIIGVKGGEISLPLSAIFTT |
| 376 | PRT | Artificial | Luk452 LukE, HlgA binding FN3 domain | LPAPKNLVVSRVTEDSARLSWTAPDAAFDSF NIHYAEYPDFGEAIVLTVPGSERSYDLTGLKP GTEYIVDIWGVKGGLGSWPLSAIFTT |
| 377 | PRT | Artificial | Luk460 LukF binding FN3 domain | LPAPKNLVVSRVTEDSARLSWIWGGESFDSF LIQYQESEKVGEAIVLTVPGSERSYDLTGLKP GTEYTVSIYGVGQIGFIYRPEGSNPLSAIFTT |
| 378 | PRT | Artificial | Luk461 LukF binding FN3 domain | LPAPKNLVVSRVTEDSARLSWLGPTATVFDS FLIQYQESEKVGEAIVLTVPGSERSYDLTGLK PGTEYTVSIYGVWSLLHHRFSNPLSAIFTT |
| 379 | PRT | Artificial | Luk462 LukF binding FN3 domain | LPAPKNLVVSRVTEDSARLSWHPIWVDFDSF LIQYQESEKVGEAIVLTVPGSERSYDLTGLKP GTEYTVSIYGVRGDGFEVILHSNPLSAIFTT |
| 380 | PRT | Artificial | Luk463 LukF binding FN3 domain | LPAPKNLVVSRVTEDSARLSWKWFKTTAFDS FLIQYQESEKVGEAIVLTVPGSERSYDLTGLK PGTEYTVSIYGVLHASEIHQWESSNPLSAIFTT |
| 381 | PRT | Artificial | Luk464 LukF binding FN3 domain | LPAPKNLVVSRVTEDSARLSWWWPVAPFDS FLIQYQESEKVGEAIVLTVPGSERSYDLTGLK PGTEYTVSIYGVGAINYVYFPTWSNPLSAIFTT |
| 382 | PRT | Artificial | Luk465 LukF binding FN3 domain | LPAPKNLVVSRVTEDSARLSWVTDPGTNFDS FLIQYQESEKVGEAIVLTVPGSERSYDLTGLK PGTEYTVSIYGVWSWVHSRYSNPLSAIFTT |
| 383 | PRT | Artificial | Luk467 LukF binding FN3 domain | LPAPKNLVVSRVTEDSARLSWPWLQYPFFDS FLIQYQESEKVGEAIVLTVPGSERSYDLTGLK PGTEYTVSIYGVGYLDWHIFQLASNPLSAIFTT |
| 384 | PRT | Artificial | Luk468 LukF binding FN3 domain | LPAPKNLVVSRVTEDSARLSWQPSHGEFANF DSFLIQYQESEKVGEAIVLTVPGSERSYDLTG LKPGTEYTVSIYGVQPWYRGGHIYDFSNPLS AIFTT |
| 385 | PRT | Artificial | Luk470 LukF binding FN3 domain | LPAPKNLVVSRVTEDSARLSWINYSDPDFFDS FLIQYQESEKVGEAIVLTVPGSERSYDLTGLK PGTEYTVSIYGVYHWWYRGTPVVSNPLSAIF TT |

TABLE 6-continued

Nucleic Acid and Amino Acid Sequences of the Disclosure

| SEQ ID NO: | Type | Species | Description | Sequence |
|---|---|---|---|---|
| 386 | PRT | Artificial | Luk473 LukF, LukD, LukAB binding FN3 domain | LPAPKNLVVSRVTEDSARLSWLEGFFPQPLFD SFLIQYLESEKVGEAIVLTVPGSERSYDLTGL KPGTEYTVSIYGVPWYHHRWWFASNPLSAIF TT |
| 387 | PRT | Artificial | Luk475 LukF binding FN3 domain | LPAPKNLVVSRVTEDSARLSWKQHTNTHYQ FDSFLIQYQESEKVGEAIVLTVPVSERSYDLT GLKPGTEYTVSIYGVRWIDNHLKFNVHSNPL SAIFTT |
| 388 | PRT | Artificial | Luk476 LukF, LukS, LukD, LukE, LukAB, HlgB, HlgC binding FN3 domain | LPAPKNLVVSRVTEDSARLSWLEGFFPQPLFD SFLIQYQESEKVGEAIVLTVPGSERSYDLTGL KPGTEYTVSIYGVPWYHHRWWFASNPLSAIF TT |
| 389 | PRT | Artificial | Luk478 HlgC binding FN3 domain | LPAPKNLVVSRVTEDSARLSWLEGFFPQPLFD SFLIQYQESEKVGEAIVLTVPGSERSYDLTGL KPGTEYTVSIYGVASRWHSFPVTTSNPLSAIF TT |
| 390 | PRT | Artificial | Luk479 LukF, LukD binding FN3 domain | LPAPKNLVVSRVTEDSARLSWLEGFFPQPLFD SFLIQYQESEKVGEAIVLTVPGSERSYGLTGL KPGTEYTVSIYGVPWYHHRWWFASNPLSAIF TT |
| 391 | PRT | Artificial | Luk483 LukF binding FN3 domain | LPAPKNLVVSRVTEDSARLSWTAPDAAFDSF RIFYYERFTWGEAIVLTVPGSERSYDLTGLKP GTEYPVHIWGVKGGIDSRPLSAIFTT |
| 392 | PRT | Artificial | Luk486 LukD, LukAB binding FN3 domain | LPAPKNLVVSRVTEDSARLSWTAPDAAFDSF AIRYGEETVHGEAIALIVPGSERSYDLTGLKP GTEYPVAIAGVKGGTWSIPLSAIFTT |
| 393 | PRT | Artificial | Luk487 LukF binding FN3 domain | LPAPKNLVVSRVTEDSARLSWTAPDAAFDSF AIHYLEFHYAGEAIVLTVPGSERSYDLTGLKP GTEYWVVIYGVKGDLISGPLSAIFTT |
| 394 | PRT | Artificial | Luk498 LukD binding FN3 domain | LPAPKNLVVSRVTEDSARLSWLPGPFRRFDSF LIQYQESEKVGEAIVLTVPGSERSYDLTGLKP GTEYTVSIYGVVNHEWYHAFSNPLSAIFTT |
| 395 | PRT | Artificial | Luk499 LukS binding FN3 domain | LPAPKNLVVSRVTEDSARLSWIGRELIWFDSF LIQYQESEKVGEAIVLTVPGSERSYDLTGLKP GTEYTVSIYGVVTHEWRSEFSNPLSAIFTT |
| 396 | PRT | Artificial | Luk500 LukS binding FN3 domain | LPAPKNLVVSRVTEDSARLSWKKPSYYIFDSF LIQYQESEKVGEAIVLTVPGSERSYDLTGLKP GTEYTVSIYGVVNHEWYHAFSNPLSAIFTT |
| 397 | PRT | Artificial | Luk505 LukS binding FN3 domain | LPAPKNLVVSRVTEDSARLSWQQAARWFDS FLIQYQESEKVGEAIVLTVPGSERSYDLTGLK PGTEYTVSIYGVVTREWFHSFSNPLSAIFTT |
| 398 | PRT | Artificial | Luk507 LukS binding FN3 domain | LPAPKNLVVSRVTEDSARLSWQHHGFRLFDS FLIQYQESEKVGEAIVLTVPGSERSYDLTGLK PGTEYTVSIYGVFTHEWFHEFSNPLSAIFTT |
| 399 | PRT | Artificial | Luk510 LukS binding FN3 domain | LPAPKNLVVSRVTEDSARLSWDEYSVTTWW FDSFLIQYQESEKVGEAIVLTVPGSERSYDLT GLKPGTEYTVSIYGVNELYRPWVASNPLSAIF TT |
| 400 | PRT | Artificial | Luk513 LukS binding FN3 domain | LPAPKNLVVSRVTEDSARLSWWTGGWRRNP FDSFLIQYQESEKVGEAIVLTVPGSERSYDLT GLKPGTEYTVSIYGVQLHRTIIAGESNPLSAIF TT |
| 401 | PRT | Artificial | Luk516 LukS binding FN3 domain | LPAPKNLVVSRVTEDSARLSWVGANSRHWF DSFLIQYQESEKVGEAIVLTVPGSERSYDLTG LKPGTEYTVSIYGVAVSEWFHSFSNPLSAIFTT |

TABLE 6-continued

Nucleic Acid and Amino Acid Sequences of the Disclosure

| SEQ ID NO: | Type | Species | Description | Sequence |
|---|---|---|---|---|
| 402 | PRT | Artificial | Luk517 LukS binding FN3 domain | LPAPKNLVVSRVTEDSARLSWVNHLEGEAW FDSFLIQYQESEKVGEAIVLTVPGSERSYDLT GLKPGTEYTVSIYGVQTHEWWHKFSNPLSAI FTT |
| 403 | PRT | Artificial | Luk519 LukS binding FN3 domain | LPAPKNLVVSRVTEDSARLSWDLEHHNYHY FDSFLIQYQESEKVGEAIVLTVPGSERSYDLT GLKPGTEYTVSIYGVWFLQPAIHPPSNPLSAIF TT |
| 404 | PRT | Artificial | Luk520 HlgC, LukS binding FN3 domain | LPAPKNLVVSRVTEDSARLSWTAPDAAFDSF AIFYYEYWSNGEAIVLTVPGSERSYDLTGLKP GTEYWVGIHGVKGGLISHPLSAIFTT |
| 405 | PRT | Artificial | Luk521 HlgC, LukS binding FN3 domain | LPAPKNLVVSRVTEDSARLSWTAPDAAFDSFI ITYEEATLNGEAIVLTVPGSERSYDLTGLKPG TEYTVGITGVKGGLGSYPLSAIFTT |
| 406 | PRT | Artificial | Luk522 HlgC, LukS binding FN3 domain | LPAPKNLVVSRVTEDSARLSWTAPDAAFDSF TIFYLEQRFQGEAIVLTVPGSERSYDLTGLKP GTEYAVIIHGVKGGWISFPLSAIFTT |
| 407 | PRT | Artificial | Luk523 HlgC, LukS binding FN3 domain | LPAPKNLVVSRVTEDSARLSWTAPDAAFDSF NIPYLERQLYGEAIVLTVPGSERSYDLTGLKP GTEYTVTIGGVKGGAPSRPLSAIFTT |
| 408 | PRT | Artificial | Luk524 HlgC, LukS binding FN3 domain | LPAPKNLVVSRVTEDSARLSWTAPDAAFDSF FIFYLEYAHPGEAIVLTVPGSERSYDLTGLKP GTEYHVIIHGVKGGLISEPLSAIFTT |
| 409 | PRT | Artificial | Luk525 HlgC, LukS binding FN3 domain | LPAPKNLVVSRVTEDSARLSWTAPDAAFDSF YIFYWESVTGGEAIVLTVPGSERSYDLTGLKP GTEYIVIIHGVKGGLISDPLSAIFTT |
| 410 | PRT | Artificial | Luk526 HlgC, LukS binding FN3 domain | LPAPKNLVVSRVTEDSARLSWTAPDAAFDSF PIFYDEHHQWGEAIVLTVPGSERSYDLTGLKP GTEYWVAIYGVKGGYYSSPLSAIFTT |
| 411 | PRT | Artificial | Luk527 HlgC, LukS binding FN3 domain | LPAPKNLVVSRVTEDSARLSWTAPDAAFDSF HIFYWEPNEVGEAIVLTVPGSERSYDLTGLKP GTEYFVEIYGVKGGEISYPLSAIFTT |
| 412 | PRT | Artificial | Luk528 HlgC, LukS binding FN3 domain | LPAPKNLVVSRVTEDSARLSWTAPDAAFDSF TIDYREETPKGEAIVLTVPGSERSYDLTGLKP GTEYWVIILGVKGGGDSFPLSAIFTT |
| 413 | PRT | Artificial | Luk529 LukS binding FN3 domain | LPAPKNLVVSRVTEDSARLSWTAPDAAFDSF GIYYGEWNPKGEAIVLTVPGSERSYDLTGLK PGTEYWVIISGVKGGPQSIPLSAIFTT |
| 414 | PRT | Artificial | Luk530 HlgC, LukD binding FN3 domain | LPAPKNLVVSRVTEDSARLSWTAPDAAFDSF GIFYHEIEENGEAIVLTVPGSERSYDLTGLKPG TEYFVAIHGVKGGVISTPLSAIFTT |
| 415 | PRT | Artificial | Luk531 HlgC, LukS binding FN3 domain | LPAPKNLVVSRVTEDSARLSWTAPDAAFDSF RIFYYELYHAGEAIVLTVPGSERSYDLTGLKP GTEYFVIIHGVKGGQISLPLSAIFTT |
| 416 | PRT | Artificial | Luk532 HlgC, LukS binding FN3 domain | LPAPKNLVVSRVTEDSARLSWTAPDAAFDSF TIFYLELESSGEAIVLTVPGSERSYDLTGLKPG TEYNVIIHGVKGGFISSPLSAIFTT |
| 417 | PRT | Artificial | Luk533 HlgC, LukS binding FN3 domain | LPAPKNLVVSRVTEDSARLSWTAPDAAFDSF PIFYVELRNPGEAIVLTVPGSERSYDLTGLKP GTEYHVVIHGVKGGFISHPLSAIFTT |
| 418 | PRT | Artificial | Luk534 HlgC, LukS binding FN3 domain | LPAPKNLVVSRVTEDSARLSWTAPDAAFDSF TIFYTEWNEFGEAIVLTVPGSERSYDLTGLKP GTEYFVIIHGVKGGQISVPLSAIFTT |
| 419 | PRT | Artificial | Luk535 HlgC, LukS binding FN3 domain | LPAPKNLVVSRVTEDSARLSWTAPDAAFDSF VIFYLEPTTQGEAIVLTVPGSERSYDLTGLKP GTEYFVIIHGVKGGPVSGPLSAIFTT |

TABLE 6-continued

Nucleic Acid and Amino Acid Sequences of the Disclosure

| SEQ ID NO: | Type | Species | Description | Sequence |
|---|---|---|---|---|
| 420 | PRT | Artificial | Luk536 HlgC, LukS binding FN3 domain | LPAPKNLVVSRVTEDSARLSWTAPDAAFDSF WIAYIETDGWGEAIVLTVPGSERSYDLTGLKP GTEYFVPIHGVKGGYISQPLSAIFTT |
| 421 | PRT | Artificial | Luk537 HlgC, LukS binding FN3 domain | LPAPKNLVVSRVTEDSARLSWTAPDAAFDSF AIFYHEHKIRGEAIVLTVPGSERSYDLTGLKP GTEYLVIIHGVKGGYISLPLSAIFTT |
| 422 | PRT | Artificial | Luk538 HlgC, LukS binding FN3 domain | LPAPKNLVVSRVTEDSARLSWTAPDAAFDSF PIFYLERANRGEAIVLTVPGSERSYDLTGLKP GTEYFVIIHGVKGGTISDPLSAIFTT |
| 423 | PRT | Artificial | Luk539 HlgC, LukS binding FN3 domain | LPAPKNLVVSRVTEDSARLSWTAPDAAFDSF AIFYLETLYHGEAIVLTVPGSERSYDLTGLKP GTEYLVVIHGVKGGHSSPLSAIFTT |
| 424 | PRT | Artificial | Luk540 LukS binding FN3 domain | LPAPKNLVVSRVTEDSARLSWTAPDAAFDSF HIEYPEDTEQGEAIVLTVPGSERSYDLTGLKP GTEYNVHITGVKGGSKSAPLSAIFTT |
| 425 | PRT | Artificial | Luk541 LukS, LukD binding FN3 domain | LPAPKNLVVSRVTEDSARLSWTAPDAAFDSF NILYTETEQSGEAIVLTVPGSERSYDLTGLKP GTEYIVIIHGVKGGFISGPLSAIFTT |
| 426 | PRT | Artificial | Luk542 LukS binding FN3 domain | LPAPKNLVVSRVTEDSARLSWTAPDAAFDSF TIFYPEFRGDGEAIVLTVPGSERSYDLTGLKP GTEYGVIIHGVKGGGDSNPLSAIFTT |
| 427 | PRT | Artificial | Luk543 HlgC, LukS binding FN3 domain | LPAPKNLVVSRVTEDSARLSWTAPDAAFDSF AIFYTETFHYGEAIVLTVPGSERSYDLTGLKP GTEYLVVIHGVKGGDISAPLSAIFTT |
| 428 | PRT | Artificial | Luk544 HlgC, LukS binding FN3 domain | LPAPKNLVVSRVTEDSARLSWTAPDAAFDSF TIHYLEEFWLGEAIVLTVPGSERSYDLTGLKP GTEYFVAIYGVKGGFISVPLSAIFTT |
| 429 | PRT | Artificial | Luk545 HlgC, LukS binding FN3 domain | LPAPKNLVVSRVTEDSARLSWTAPDAAFDSF VIAYIEERWSGEAIVLTVPGSERSYDLTGLKP GTEYFVLIHGVKGGFISNPLSAIFTT |
| 430 | PRT | Artificial | Luk546 LukS binding FN3 domain | LPAPKNLVVSRVTEDSARLSWTAPDAAFDSF SIYYGEWPHGGEAIVLTVPGSERSYDLTSLKP GTEYFVLIIGVKGGQLSHPLSAIFTT |
| 431 | PRT | Artificial | Luk547 HlgC, LukS binding FN3 domain | LPAPKNLVVSRVTEDSARLSWTAPDAAFDSF TIFYLESSGTGEAIVLTVPGSERSYDLTGLKPG TEYLVIIHGVKGGRISNPLSAIFTT |
| 432 | PRT | Artificial | Luk548 HlgC, LukS, LukD binding FN3 domain | LPAPKNLVVSRVTEDSARLSWTAPDAAFDSF AIYYGEWHPDGEAIVLTVPGSERSYDLTGLK PGTEYWVFILGVKGGQNSQPLSAIFTT |
| 433 | PRT | Artificial | Luk549 HlgC, LukS binding FN3 domain | LPAPKNLVVSRVTEDSARLSWTAPDAAFDSF TIFYAESGNWGEAIVLTVPGSERSYDLTGLKP GTEYFVFIWGVKGGHESHPLSAIFTT |
| 434 | PRT | Artificial | Luk550 HlgC, LukS binding FN3 domain | LPAPKNLVVSRVTEDSARLSWTAPDAAFDSF AIFYAETDTKGEAIVLTVPGSERSYDLTGLKP GTEYLVIIHGVKGGSISVPLSAIFTT |
| 435 | PRT | Artificial | Luk551 HlgC, LukS binding FN3 domain | LPAPKNLVVSRVTEDSARLSWTAPDAAFDSF RIFYQEYSNHGEAIVLTVPGSERSYDLTGLKP GTEYFVPIYGVKGGFISRPLSAIFTT |
| 436 | PRT | Artificial | Luk552 HlgC, LukS binding FN3 domain | LPAPKNLVVSRVTEDSARLSWTAPDAAFDSF QIFYDENLWLGEAIVLTVPGSERSYDLTGLKP GTEYFVAIHGVKGGFISQPLSAIFTT |
| 437 | PRT | Artificial | Luk553 HlgC, LukS binding FN3 domain | LPAPKNLVVSRVTEDSARLSWTAPDAAFDSF HIFYAEHEKWGEAIVLTVPGSERSYDLTGLKP GTEYWVAIHGVKGGHISRPLSAIFTT |

TABLE 6-continued

Nucleic Acid and Amino Acid Sequences of the Disclosure

| SEQ ID NO: | Type | Species | Description | Sequence |
|---|---|---|---|---|
| 438 | PRT | Artificial | Luk554 HlgC, LukS binding FN3 domain | LPAPKNLVVSRVTEDSARLSWTAPDAAFDSF SIFYLETFRRGEAIVLTVPGSERSYDLTGLKPG TEYLVIIHGVKGGYVSDPLSAIFTT |
| 439 | PRT | Artificial | Luk555 HlgC, LukS binding FN3 domain | LPAPKNLVVSRVTEDSARLSWTAPDAAFDSF SIFYPETNYQGEAIVLTVPGSERSYDLTGLKP GTEYLVVIHGVKGGYISDPLSAIFTT |
| 440 | PRT | Artificial | Luk556 HlgC, LukS binding FN3 domain | LPAPKNLVVSRVTEDSARLSWTAPDAAFDSF AIFYIEEETNGEAIVLTVPGSERSYDLTGLKPG TEYQVIIHGVKGGFISLPLSAIFTT |
| 441 | PRT | Artificial | Luk557 HlgC, LukS binding FN3 domain | LPAPKNLVVSRVTEDSARLSWTAPDAAFDSF VIFYPEVNFRGEAIVLTVPGSERSYDLTGLKP GTEYLVIIHGVKGGYISTPLSAIFTT |
| 442 | PRT | Artificial | Luk558 HlgC, LukS binding FN3 domain | LPAPKNLVVSRVTEDSARLSWTAPDAAFDSF AIFYHEWWKSGEAIVLTVPGSERSYDLTGLK PGTEYHVVIHGVKGGHISTPLSAIFTT |
| 443 | PRT | Artificial | Luk559 HlgC, LukS binding FN3 domain | LPAPKNLVVSRVTEDSARLSWTAPDAAFDSF TIHYPETRPTGEAIVLTVPGSERSYDLTGLKP GTEYFVVIYGVKGGWISPPLSAIFTT |
| 444 | PRT | Artificial | Luk560 HlgC, LukS binding FN3 domain | LPAPKNLVVSRVTEDSARLSWTAPDAAFDSF HIFYIEHVQVGEAIVLTVPGSERSYDLTGLKP GTEYFVIIHGVKGGIISPPLSAIFTT |
| 445 | PRT | Artificial | Luk561 HlgC, LukS binding FN3 domain | LPAPKNLVVSRVTEDSARLSWTAPDAAFDSF TIFYYPELYFHGEAIVLTVPGSERSYDLTGLK PGTEYLVVIHGVKGGFISPPLSAIFTT |
| 446 | PRT | Artificial | Luk562 LukS, LukAB binding FN3 domain | LPAPKNLVVSRVTEDSARLSWTAPDAAFDSF AIFYKEYTHGGEAIVLTVPGSERSYDLTGLKP GTEYWVIIHSVKGGSISYPLSAIFTT |
| 447 | PRT | Artificial | Luk563 HlgC, LukS binding FN3 domain | LPAPKNLVVSRVTEDSARLSWTAPDAAFDSF QIFYPEHYQDGEAIVLTVPGSERSYDLTGLKP GTEYLVVIHGVKGGWISSPLSAIFTT |
| 448 | PRT | Artificial | Luk564 HlgC, LukS binding FN3 domain | LPAPKNLVVSRVTEDSARLSWTAPDAAFDSF TIFYIEFRYPGEAIVLTVPGSERSYDLTGLKPG TEYFVAIHGVKGGYISDPLSAIFTT |
| 449 | PRT | Artificial | Luk565 HlgC, LukS binding FN3 domain | LPAPKNLVVSRVTEDSARLSWTAPDAAFDSF HIFYLETWGSGEAIVLTVPGSERSYDLTGLKP GTEYFVVIHGVKGGLISSPLSAIFTT |
| 450 | PRT | Artificial | Luk566 HlgC, LukS binding FN3 domain | LPAPKNLVVSRVTEDSARLSWTAPDAAFDSF AIFYYEHADAGEAIVLTVPGSERSYDLTGLKP GTEYFVIIHGVKGGYISKPLSAIFTT |
| 451 | PRT | Artificial | Luk567 HlgC, LukS binding FN3 domain | LPAPKNLVVSRVTEDSARLSWTAPDAAFDSF AIFYQEDSDHGEAIVLTVPGSERSYDLTGLKP GTEYFVAIHGVKGGTISKPLSAIFTT |
| 452 | PRT | Artificial | Luk568 HlgC, LukS binding FN3 domain | LPAPKNLVVSRVTEDSARLSWTAPDAAFDSF RIFYIEEHDVGEAIVLTVPGSERSYDLTGLKP GTEYIVIIHGVKGGYISDPLSAIFTT |
| 453 | PRT | Artificial | Luk569 HlgC, LukS binding FN3 domain | LPAPKNLVVSRVTEDSARLSWTAPDAAFDSF TILYPETQTIGEAIVLTVPGSERSYDLTGLKPG TEYFVGIHGVKGGIISDPLSAIFTT |
| 454 | PRT | Artificial | Luk570 LukS, LukD, LukAB binding FN3 domain | LPAPKNLVVSRVTEDSARLSWTAPDAAFDSFI IYYGEWREHGEAIVLTVPGSERSYDLTGLKP GTEYFVLIQGVKGGQTSGPLSAIFTT |
| 455 | PRT | Artificial | Luk571 HlgC, LukS binding FN3 domain | LPAPKNLVVSRVTEDSARLSWTAPDAAFDSF KIFYLEPKENGEAIVLTVPGSERSYDLTGLKP GTEYFVIITGVKGGFISEPLSAIFTT |

TABLE 6-continued

Nucleic Acid and Amino Acid Sequences of the Disclosure

| SEQ ID NO: | Type | Species | Description | Sequence |
|---|---|---|---|---|
| 456 | PRT | Artificial | Luk572 LukS binding FN3 domain | LPAPKNLVVSRVTEDSARLSWTAPDAAFDSF LIHYDEWENGGEAIVLTVPGSERSYDLTGLK PGTEYWVIIIGVKGGVRSNPLSAIFTT |
| 457 | PRT | Artificial | Luk575 HlgC, LukS binding FN3 domain | LPAPKNLVVSRVTEDSARLSWTAPDAAFDSF PIFYVEIPQPGEAIVLTVPGSERSYDLTGLKPG TEYFVIIHGVKGGGISDPLSAIFTT |
| 458 | PRT | Artificial | Luk576 HlgC, LukS binding FN3 domain | LPAPKNLVVSRVTEDSARLSWTAPDAAFDSF VILYHEYWASGEAIVLTVPGSERSYDLTGLKP GTEYFVVIHGVKGGFLSDPLSAIFTT |
| 459 | PRT | Artificial | Luk577 HlgC, LukS binding FN3 domain | LPAPKNLVVSRVTEDSARLSWTAPDAAFDSF HIFYCEHWTSGEAIVLTVPGSERSYDLTGLKP GTEYFVAIHGVKGGEISAPLSAIFTT |
| 460 | PRT | Artificial | Luk578 HlgC, LukS binding FN3 domain | LPAPKNLVVSRVTEDSARLSWTAPDAAFDSF TIFYQEHLGYGEAIVLTVPGSERSYDLTGLKP GTEYVVVIHGVKGGWISSPLSAIFTT |
| 461 | PRT | Artificial | Luk579 HlgC, LukS binding FN3 domain | LPAPKNLVVSRVTEDSARLSWTAPDAAFDSF TIIYEETANGGEAIVLTVPGSERSYDLTGLKP GTEYFVVIHGVKGGHISSPLSAIFTT |
| 462 | PRT | Artificial | Luk580 HlgC, LukS, LukAB binding FN3 domain | LPAPKNLVVSRVTEDSARLSWTAPDAAFDSF QIFYPETQKYGEAIVLTVPGSERSYDLTGLKP GTEYFVVIHGVKGGFISSPLSAIFTT |
| 463 | PRT | Artificial | Luk581 HlgC, LukS binding FN3 domain | LPAPKNLVVSRVTEDSARLSWTAPDAAFDSF VIFYGEYENGGEAIVLTVPGSERSYDLTGLKP GTEYFVIIVGVKGGFDSKPLSAIFTT |
| 464 | PRT | Artificial | Luk582 HlgC, LukS binding FN3 domain | LPAPKNLVVSRVTEDSARLSWTAPDAAFDSF NIFYHETVDKGEAIVLTVPGSERSYDLTGLKP GTEYFVVVSGVKGGYISDPLSAIFTT |
| 465 | PRT | Artificial | Luk583 HlgC, LukS binding FN3 domain | LPAPKNLVVSRVTEDSARLSWTAPDAAFDSF QIFYREESKYGEAIVLTVPGSERSYDLTGLKP GTEYFVPIHGVKGGEISDPLSAIFTT |
| 466 | PRT | Artificial | Luk584 HlgC, LukS binding FN3 domain | LPAPKNLVVSRVTEDSARLSWTAPDAAFDSF QIFYQEVVEWGEAIVLTVPGSERSYDLTGLKP GTEYFVVIHGVKGGWISDPLSAIFTT |
| 467 | PRT | Artificial | Luk585 HlgC, LukS binding FN3 domain | LPAPKNLVVSRVTEDSARLSWTAPDAAFDSF TIFYPETWIAGEAIVLTVPGSERSYDLTGLKP GTEYLVVIHGVKGGIISWPLSAIFTT |
| 468 | PRT | Artificial | Luk587 HlgC, LukS binding FN3 domain | LPAPKNLVVSRVTEDSARLSWTAPDAAFDSF VIPYQEYLGWGEAIVLTVPGSERSYDLTGLKP GTEYWVGIYGVKGGFISPPLSAIFTT |
| 469 | PRT | Artificial | Luk588 HlgC, LukS binding FN3 domain | LPAPKNLVVSRVTEDSARLSWTAPDAAFDSF AIFYYEHQVAGEAIVLTVPGSERSYDLTGLKP GTEYFVAIHGVKGGWISSPLSAIFTT |
| 470 | PRT | Artificial | Luk589 HlgC, LukS binding FN3 domain | LPAPKNLVVSRVTEDSARLSWTAPDAAFDSF TIIYAEEQRNGEAIVLTVPGSERSYDLTGLKP GTEYFVIIHGVKGGFISPPLSAIFTT |
| 471 | PRT | Artificial | Luk590 HlgC, LukS binding FN3 domain | LPAPKNLVVSRVTEDSARLSWTAPDAAFDSF SIFYLEERLTGEAIVLTVPGSERSYDLTGLKPG TEYLVVIHGVKGGVISDPLSAIFTT |
| 472 | PRT | Artificial | Luk592 HlgC, LukS binding FN3 domain | LPAPKNLVVSRVTEDSARLSWTAPDAAFDSF TIFYYEAVHQGEAIVLTVPGSERSYDLTGLKP GTEYFVVIHGVKGGNISVPLSAIFTT |
| 473 | PRT | Artificial | Luk593 HlgC, LukS binding FN3 domain | LPAPKNLVVSRVTEDSARLSWTAPDAAFDSF AIFYVELVWKGEAIVLTVPGSERSYDLTGLKP GTEYFVVIHGVKGGYISDPLSAIFTT |

TABLE 6-continued

Nucleic Acid and Amino Acid Sequences of the Disclosure

| SEQ ID NO: | Type | Species | Description | Sequence |
|---|---|---|---|---|
| 474 | PRT | Artificial | Luk594 HlgC, LukS binding FN3 domain | LPAPKNLVVSRVTEDSARLSWTAPDAAFDSF VIHYGEYENGGEAIVLTVPGSERSYDLTGLKP GTEYFVAIHGVKGGFISDPLSAIFTT |
| 475 | PRT | Artificial | Luk595 HlgC, LukS binding FN3 domain | LPAPKNLVVSRVTEDSARLSWTAPDAAFDSF TIIYFETKAYGEAIVLTVPGSERSYDLTGLKPG TEYWVIIHGVKGGYISVPLSAIFTT |
| 476 | PRT | Artificial | Luk596 HlgC, LukS binding FN3 domain | LPAPKNLVVSRVTEDSARLSWTAPDAAFDSF VIFYDEEWSKGEAIVLTVPGSERSYDLTGLKP GTEYAVFIYGVKGGAISEPLSAIFTT |
| 477 | PRT | Artificial | Luk597 HlgC, LukS binding FN3 domain | LPAPKNLVVSRVTEDSARLSWTAPDAAFDSF YIHYLETDPGGEAIVLTVPGSERSYDLTGLKP GTEYFVSIYGVKGGWISPPLSAIFTT |
| 478 | PRT | Artificial | Luk598 HlgC, LukS binding FN3 domain | LPAPKNLVVSRVTEDSARLSWTAPDAAFDSF VIFYDEDRPQGEAIVLTVPGSERSYDLTGLKP GTEYFVVIHGVKGGYLSIPLSAIFTT |
| 479 | PRT | Artificial | Luk599 HlgC, LukS binding FN3 domain | LPAPKNLVVSRVTEDSARLSWTAPDAAFDSF YIFYREETPHGEAIVLTVPGSERSYDLTGLKP GTEYWVLILGVKGGGISEPLSAIFTT |
| 480 | PRT | Artificial | Luk601 HlgC, LukS binding FN3 domain | LPAPKNLVVSRVTEDSARLSWTAPDAAFDSF TIFYIEDNKVGEAIVLTVPGSVRSYDLTGLKP GTEYFVVIHGVKGGIISEPLSAIFTT |
| 481 | PRT | Artificial | Luk602 HlgC, LukS binding FN3 domain | LPAPKNLVVSRVTEDSARLSWTAPDAAFDSF VIFYQELNRDGEAIVLTVPGSERSYDLTGLKP GTEYLVIIHGVKGGFISPPLSAIFTT |
| 482 | PRT | Artificial | Luk603 HlgC, LukS binding FN3 domain | LPAPKNLVVSRVTEDSARLSWTAPDAAFDSF HIFYLEFWYRGEAIVLTVPGSERSYDLTGLKP GTEYNVIIHGVKGGWISEPLSAIFTT |
| 483 | PRT | Artificial | Luk604 LukS binding FN3 domain | LPAPKNLVVSRVTEDSARLSWTAPDAAFDSF QIFYGEWPQEGEAIVLTVPGSERSYDLTGLKP GTEYWVVILGVKGGQASPPLSAIFTT |
| 484 | PRT | Artificial | Luk605 HlgC, LukS, LukD binding FN3 domain | LPAPKNLVVSRVTEDSARLSWTAPDAAFDSF RIHYLEHAARGEAIVLTVPGSERSYDLTGLKP GTEYFVAIYGVKGGYISFPLSAIFTT |
| 485 | PRT | Artificial | Luk606 HlgC, LukS binding FN3 domain | LPAPKNLVVSRVTEDSARLSWTAPDAAFDSF TIHYLESYPRGEAIVLTVPGSERSYDLTGLKP GTEYFVAIYGVKGGYLSPPLSAIFTT |
| 486 | PRT | Artificial | Luk607 HlgC, LukS binding FN3 domain | LPAPKNLVVSRVTEDSARLSWTAPDAAFDSF QIFYHEWVPWGEAIVLTVPGSERSYDLTGLK PGTEYFVVIHGVKGGTISFPLSAIFTT |
| 487 | PRT | Artificial | Luk608 HlgC, LukS binding FN3 domain | LPAPKNLVVSRVTEDSARLSWTAPDAAFDSF NIFYGEYENGGEAIVLTVPGSERSYDLTGLKP GTEYFVFIIGVKGGPDSLPLSAIFTT |
| 488 | PRT | Artificial | Luk609 HlgC, LukS binding FN3 domain | LPAPKNLVVSRVTEDSARLSWTAPDAAFDSF DIRYWEGPGYGEAIVLTVPGSERSYDLTGLK PGTEYRVRIVGVKGGKRSEPLSAIFTT |
| 489 | PRT | Artificial | Luk610 LukS binding FN3 domain | LPAPKNLVVSRVTEDSARLSWTAPDAAFDSF FIYYGEYDPVGEAIVLTVPGSERSYDLTGLKP GTEYFVIIQGVKGGQASGPLSAIFTT |
| 490 | PRT | Artificial | Luk611 HlgC, LukS binding FN3 domain | LPAPKNLVVSRVTEDSARLSWTAPDAAFDSF HIAYAEFWRYGEAIVLTVPGSERSYDLTGLK PGTEYWVNIAGVKGGEWSKPLSAIFTT |
| 491 | PRT | Artificial | Luk612 HlgC, LukS binding FN3 domain | LPAPKNLVVSRVTEDSARLSWTAPDAAFDSF TIFYQEESKYGEAIVLTVPGSERSYDLTGLKP GTEYFVVIHGVKGGAISQPLSAIFTT |

TABLE 6-continued

Nucleic Acid and Amino Acid Sequences of the Disclosure

| SEQ ID NO: | Type | Species | Description | Sequence |
|---|---|---|---|---|
| 492 | PRT | Artificial | Luk613 HlgC, LukS binding FN3 domain | LPAPKNLVVSRVTEDSARLSWTAPDAAFDSF NIFYIETDKPGEAIVLTVPGSERSYDLTGLKPG TEYFVAIHGVKGGFISEPLSAIFTT |
| 493 | PRT | Artificial | Luk614 HlgC, HlgA, LukS binding FN3 domain | LPAPKNLVVSRVTEDSARLSWTAPDAAFDSF QIFYTEPVGHGEAIVLTVPGSERSYDLTGLKP GTEYFVAIHGVKGGTISPPLSAIFTT |
| 494 | PRT | Artificial | Luk615 HlgC, LukS binding FN3 domain | LPAPKNLVVSRVTEDSARLSWTAPDAAFDSF HIFYIEHRLQGEAIVLTVPGSERSYDLTGLKP GTEYLVLIHGVKGGFISPPLSAIFTT |
| 495 | PRT | Artificial | Luk616 HlgC, LukS binding FN3 domain | LPAPKNLVVSRVTEDSARLSWTAPDAAFDSF HIFYHEGLKSGEAIVLTVPGSERSYDLTGLKP GTEYLVVIHGVKGGTISNPLSAIFTT |
| 496 | PRT | Artificial | Luk617 HlgC, LukS binding FN3 domain | LPAPKNLVVSRVTEDSARLSWTAPDAAFDSF VIFYHETRVTGEAIVLTVPGSERSYDLTGLKP GTEYLVVIHGVKGGYISEPLSAIFTT |
| 497 | PRT | Artificial | Luk618 HlgC, LukS binding FN3 domain | LPAPKNLVVSRVTEDSARLSWTAPDAAFDSF SIFYQEAVEGGEAIVLTVPGSERSYDLTGLKP GTEYFVPIHGVKGGWISQPLSAIFTT |
| 498 | PRT | Artificial | Luk619 LukS binding FN3 domain | LPAPKNLVVSRVTEDSARLSWTAPDAAFDSF QILYVEEFTRGEAIVLTVPGSERSYDLTGLKP GTEYVVIHGVKGGYISKPLSAIFTT |
| 499 | PRT | Artificial | Luk620 HlgC, LukS binding FN3 domain | LPAPKNLVVSRVTEDSARLSWTAPDAAFDSF TYIEALGFGEAIVLTVPGSERSYDLTGLKPGT EYFVAIYGVKGGYISEPLSAIFTT |
| 500 | PRT | Artificial | Luk621 HlgC, LukS binding FN3 domain | LPAPKNLVVSRVTEDSARLSWTAPDAAFDSF VIFYLEHWNPGEAIVLTVPGSERSYDLTGLKP GTEYLVPIHGVKGGSISPPLSAIFTT |
| 501 | PRT | Artificial | Luk622 HlgC, LukS binding FN3 domain | LPAPKNLVVSRVTEDSARLSWTAPDAAFDSF TIFYVEWEVVGEAIVLTVPGSERSYDLTGLKP GTEYFVVIHGVKGGVISNPLSAIFTT |
| 502 | PRT | Artificial | Luk623 LukS binding FN3 domain | LPAPKNLVVSRVTEDSARLSWTAPDAAFDSF RIFYLEESKNGEAIVLTVPGSERSYDLTGLKP GTEYQVVIHGVKGGVISPPLSAIFTT |
| 503 | PRT | Artificial | Luk624 HlgC, LukS binding FN3 domain | LPAPKNLVVSRVTEDSARLSWTAPDAAFDSF AIFYNEDHKSGEAIVLTVPGSERSYDLTGLKP GTEYLVVIHGVKGGYISKPLSAIFTT |
| 504 | PRT | Artificial | Luk625 HlgC, LukS binding FN3 domain | LPAPKNLVVSRVPEDSARLSWTAPDAAFDSF LIDYQEWHEGEAIHLLVPGSERSYDLTGLKP GTEYAVIIVGVKGGKGSHPLSAIFTT |
| 505 | PRT | Artificial | Luk626 HlgC, LukS binding FN3 domain | LPAPKNLVVSRVTEDSARLSWTAPYAAFDSF WIGYYETTIPGEAIDLVVPGSERSYDLTGLKP GTEYGVGIDGVKGGRYSHPLSAIFTT |
| 506 | PRT | Artificial | Luk627 LukS binding FN3 domain | LPAPKNLVVSRVTEDSARLSWTAPDAAFDSF AIFYKEEAIPGEAIALIVPGSERSYDLTGLKPG TEYFVPIHGVKGGYISTPLSAIFTT |
| 507 | PRT | Artificial | Luk628 LukS binding FN3 domain | LPAPKNLVVSRVTEDSARLSWTAPDAAFDSF LIDYTELHNWGEAIHLFVPGSERSYDLTGLKP GTEYTVLIVGVKGGTGSIPLSAIFTT |
| 508 | PRT | Artificial | Luk629 HlgC, LukS binding FN3 domain | LPAPKNLVVSRVTEDSARLSWTAPDAAFDSF YITYEEEWWTGEAIFLDVPGSERSYDLTGLKP GTEYLVTIKGVKGGPWSQPLSAIFTT |
| 509 | PRT | Artificial | Luk630 LukS binding FN3 domain | LPAPKNLVVSRVTEDSARLSWTAPDAAFDSF AIWYHEWGPVGEAILLYVPGSERSYDLTGLK PGTEYPVAIHGVKGGGTSHPLSAIFTT |

TABLE 6-continued

Nucleic Acid and Amino Acid Sequences of the Disclosure

| SEQ ID NO: | Type | Species | Description | Sequence |
|---|---|---|---|---|
| 510 | PRT | Artificial | Luk631 LukS binding FN3 domain | LPAPKNLVVSRVTEDSARLSWTAPDAAFDSF RIFYEELRYKGEAIWLFVPGSERSYDLTGLKP GTEYHVHIWGVKGGYFSRPLSAIFTT |
| 511 | PRT | Artificial | Luk632 LukS binding FN3 domain | LPAPKNLVVSRVTEDSARLSWTAPDAAFDSFI IDYWEQWNTGEAIHLYVPGSERSYDLTGLKP GTEYSVYIVGVKGGYASWPLSAIFTT |
| 512 | PRT | Artificial | Luk633 HlgC, LukS binding FN3 domain | LPAPKNLVVSRVTEDSARLSWTAPDAAFDSF WIGYDENHLYGEAIDLVVPGSERSYDLTGLK PGTEYTVSIAGVKGGLESFPLSAIFTT |
| 513 | PRT | Artificial | Luk634 LukS binding FN3 domain | LPAPKNLVVSRVTEDSARLSWTAPEAAFDSF HISYWEFPLGGEAIGLWVPGSERSYDLTGLKP GTEYFVIIAGVKGGEFSNPLSAIFTT |
| 514 | PRT | Artificial | Luk635 HlgC, LukS binding FN3 domain | LPAPKNLVVSRVTEDSARLSWTAPDAAFDSFI IEYHEWFAKGEAIGLVVPGSERSYDLTGLKP GTEYSVIIVGVKGGAYSFPLSAIFTT |
| 515 | PRT | Artificial | Luk636 HlgC, LukS binding FN3 domain | LPAPKNLVVSRVTEDSARLSWTAPDAAFDSF LIDYWEGEFDGEAIHLFVPGSERSYDLTGLKP GTEYDVFIVGVKGGHGSDPLSAIFTT |
| 516 | PRT | Artificial | Luk637 HlgC, LukS binding FN3 domain | LPAPKNLVVSRVTEDSARLSWTAPDAAFDSF QIPYYELDSVGEAIVLTVPGSERSYDLTGLKP GTEYFVGIYGVKGGYISPPLSAIFTT |
| 517 | PRT | Artificial | Luk638 LukS binding FN3 domain | LPAPKNLVVSRVTEDSARLSWTAPDAAFDSF YIGYGEYDPTGEAIVLTVPGSERSYDLTGLKP GTEYWVLISGVKGGYYSDPLSAIFTT |
| 518 | PRT | Artificial | Luk639 HlgC, LukS binding FN3 domain | LPAPKNLVVSRVTEDSARLSWTAPDAAFDSF VIYYLESVARGEAIVLTVPGSERSYDLTGLKP GTEYFVPIYGVKGGYISYPLSAIFTT |
| 519 | PRT | Artificial | Luk640 HlgC, LukS binding FN3 domain | LPAPKNLVVSRVTEDSARLSWTAPDAAFDSF TIPYWESYYSGEAIVLTVPGSERSYDLTGLKP GTEYVVAIYGVKGGYISSPLSAIFTT |
| 520 | PRT | Artificial | Luk641 LukS binding FN3 domain | LPAPKNLVVSRVTEDSARLSWTAPDAAFDSF GIYYGEYHSGGEAIVLTVPGSERSYDLTGLKP GTEYFVLIDGVKGGLYSGPLSAIFTT |
| 521 | PRT | Artificial | Luk642 LukS binding FN3 domain | LPAPKNLVVSRVTEDSARLSWTAPDAAFDSF YIVYAEYYWYGEAIVLTVPGSERSYDLTGLK PGTEYYVYIAGVKGGYGSDPLSAIFTT |
| 522 | PRT | Artificial | Luk643 HlgC, LukS binding FN3 domain | LPAPKNLVVSRVTEDSARLSWTAPDAAFDSF TIPYYESNLGGEAIVLTVPGSERSYDLTGLKP GTEYWVGIYGVKGGHISSPLSAIFTT |
| 523 | PRT | Artificial | Luk644 HlgC, LukS binding FN3 domain | LPAPKNLVVSRVTEDSARLSWTAPDAAFDSF TILYYELIDSGEAIVLTVPGSERSYDLTGLKPG TEYFVGIYGVKGGYISLPLSAIFTT |
| 524 | PRT | Artificial | Luk645 HlgC, LukS binding FN3 domain | LPAPKNLVVSRVTEDSARLSWTAPDAAFDSF WISYGEYWPSGEAIVLTVPGSERSYDLTGLKP GTEYFVLIRGVKGGDYSNPLSAIFTT |
| 525 | PRT | Artificial | Luk646 LukD binding FN3 domain | LPAPKNLVVSRVTEDSARLSWTAPDAAFDSF RIFYGEYDGGGEAIVLTVPGSERSYDLTGLKP GTEYGVYIYGVKGGYISQPLSAIFTT |
| 526 | PRT | Artificial | Luk647 LukS binding FN3 domain | LPAPKNLVVSRVTEDSARLSWTAPDAAFDSF SIYYGEWDPTGEAIVLTVPGSERSYDLTGLKP GTEYWVLIVGVKGGSTSAPLSAIFTT |
| 527 | PRT | Artificial | Luk648 LukS binding FN3 domain | LPAPKNLVVSRVTEDSARLSWTAPDAAFDSF WIGYEEYYLVGEAIVLTVPGSERSYDLTGLK PGTEYLVWIKGVKGGYVGRPLSAIFTT |

TABLE 6-continued

Nucleic Acid and Amino Acid Sequences of the Disclosure

| SEQ ID NO: | Type | Species | Description | Sequence |
|---|---|---|---|---|
| 528 | PRT | Artificial | Luk649 LukS binding FN3 domain | LPAPKNLVVSRVTEDSARLSWTAPDAAFDSF GIAYSERVRYGEAIVLTVPGSERSYDLTGLKP GTEYWVGISGVKGGPYSEPLSAIFTT |
| 529 | PRT | Artificial | Luk650 HlgC, LukS binding FN3 domain | LPAPKNLVVSRVTEDSARLSWTAPDAAFDSF TIHYYESYTVGEAIVLTVPGSERSYDLTGLKP GTEYWVGIYGVKGGYISEPLSAIFTT |
| 530 | PRT | Artificial | Luk651 HlgA, LukD, LukAB binding FN3 domain | LPAPKNLVLSRVTEDSARLSWAQATYYQFDS FLIQYQESEKVGEAIVLTVPGSERSYDLTGLK PGTEYTVSIYGVLEVIPKLRYKVYSNPLSAIFTT |
| 531 | PRT | Artificial | Luk652 HlgA binding FN3 domain | LPAPKNLVVSRVTEDSARLSWSEVEDIPFDSF LIQYQESEKVGEAIVLTVPGSERSYDLTGLKP GTEYTVSIYGVLHYNRGQHPWHSNPLSAIFTT |
| 532 | PRT | Artificial | Luk653 HlgA binding FN3 domain | LPAPKNLVVSRVTEDSARLSWNLEVAFYFDS FLIQYQESEKVGEAIVLTVPGSERSYDLTGLK PGTEYTVSIYGVEHLDEVWWTANLSNPLSAI FTT |
| 533 | PRT | Artificial | Luk654 HlgA, LukD binding FN3 domain | LPAPKNLVVSRVTEDSARLSWSHFPNDWFDS FLIQYQESEKVGEAIVLTVPGSERSYDLTGLK PGTEYTVSIYGVHYWQFDIQSNPLSAIFTT |
| 534 | PRT | Artificial | Luk655 HlgA binding FN3 domain | LPAPKNLVVCRVTEDSARLSWRTYTSDAGFD SFLIQYQESEKVGEAIVLTVPGSERSYDLTGL KPGTEYTVSIYGVHEHAHIQYWHWSNPLSAI FTT |
| 535 | PRT | Artificial | Luk656 HlgA binding FN3 domain | LPAPKNLVVSRVTEDSARLSWKREQWANYF DSFLIQYQESEKVGEAIVLTVPGSERSYDLTG LKPGTEYTVSIYGVWEHLYKELWSYTSNPLS AIFTT |
| 536 | PRT | Artificial | Luk657 LukF binding FN3 domain | LPAPKNLVVSRVTEDSARLSWSELEARTHFD SFLIQYQESEKVSEAIVLTVPGSERSYDLTGL KPGTEYTVSIYGVAQQLVAWRGSNPLSAIFTT |
| 537 | PRT | Artificial | Luk658 LukD binding FN3 domain | LPAPKNLVVSRVTEDSARLSWKRARLDLPFD SFLIQYQESEKVGEAIVLTVPGSERSYDLTGL KPGTEYTVSIYGVDAWIPTVGSNPLSAIFTT |
| 538 | PRT | Artificial | Luk659 HlgA binding FN3 domain | LPAPKNLVVSRVTEDSARLSWINYWVLNYFD SFLIQYQESEKVGEAIVLTVPGSERSYDLTGL KPGTEYTVSIYGVEVWPQDHEWIDSNPLSAIF TT |
| 539 | PRT | Artificial | Luk660 HlgA binding FN3 domain | LPAPKNLVVSRVTEDSARLSWYREVDFTTFD SFLIQYQESEKVGEAIVLTVPGSERSYDLTGL KPGTEYTVSIYGVSSYYILHSNPLSAIFTT |
| 540 | PRT | Artificial | Luk661 LukAB binding FN3 domain | LPAPKNLVVSRVTEDSARLSWTAPDAAFDSF LITYREQIFAGEVIVLTVPGSERSYDLTGLKPG TEYPVCIYGVKGGPISDPLSAIFTT |
| 541 | PRT | Artificial | Luk662 LukS binding FN3 domain | LPAPKNLVVSRVTEDSARLSWTAPDAAFDSF VINYREVINEGEAIILHVPGSERSYRPERSETG YRIHRHHSWC |
| 542 | PRT | Artificial | Luk663 LukD binding FN3 domain | LPAPKNLVVSRVTEDSARLSWVVHNHLAFDS FLIQYQESEKVGEAIVLTVPGSERSYDLTGLK PGTEYTVSIYGVEPYVYAQYESNPLSAIFTT |
| 543 | PRT | Artificial | Luk664 HlgC binding FN3 domain | LPAPKNLVVSRVTEDSARLSWKRKSGAPFDS FLIQYQESEKVGEAIVLTVPGSERSYDLTGLK PGTEYTVSIYGVHGWDPGSDSNPLSAIFTT |
| 544 | PRT | Artificial | Luk665 HlgC binding FN3 domain | LPAPKNLVVSRVTEDSARLSWWHVRGHDFD SFLIQYQESEKVGEAIVLTVPGSERSYDLTGL KPGTEYTVSIYGVVWLPTTDSNPLSAIFTT |

TABLE 6-continued

Nucleic Acid and Amino Acid Sequences of the Disclosure

| SEQ ID NO: | Type | Species | Description | Sequence |
|---|---|---|---|---|
| 545 | PRT | Artificial | Luk666 HlgC binding FN3 domain | LPAPKNLVVSRVTEDSARLSWSPDRARFDSF LIQYQESEKVGEAIVLTVPGSERSYDLTGLKP GTEYTVSIYGVWSWDNDDASNPLSAIFTT |
| 546 | PRT | Artificial | Luk667 HlgC binding FN3 domain | LPAPKNLVVSRVTEDSARLSWFAGLQLFDSF LIQYQESEKVGEAIVLTVPGSERSYDLTGLKP GTEYTVSIYGVDWTVEEQSYHLWSNPLSAIF TT |
| 547 | PRT | Artificial | Luk668 HlgC binding FN3 domain | LPAPKNLVVSRVTEDSARLSWTIPHYTFDSFL IQYQESEKVGEAIVLTVPGSERSYDLTGLKPG TEYTVSIYGVPGKYIEPRWHFSNPLSAIFTT |
| 548 | PRT | Artificial | Luk669 HlgC binding FN3 domain | LPAPKNLVVSRVTEDSARLSWKRYSWLFDSF LIQYQESEKVGEAIVLTVPGSERSYDLTGLKP GTEYTVSIYGVLTWDPNDPSNPLSAIFTT |
| 549 | PRT | Artificial | Luk670 HlgC binding FN3 domain | LPAPKNLVVSRVTEDSARLSWKTIVTTIFDSF LIQYQESEKVGEAIVLTVPGSERSYDLTGLKP GTEYTVSIYGVDHRGFPFWQYWSSNPLSAIFTT |
| 550 | PRT | Artificial | Luk671 LukS binding FN3 domain | LPAPKNLVVSRVTEDSARLSWYARRIYFDSF LIQYQESEKVGEAIVLTVPGSERSYDLTGLKP GTEYTVSIYGVETPNPYYDSNPLSAIFTT |
| 551 | PRT | Artificial | Luk672 HlgC binding FN3 domain | LPAPKNLVVSRVTEDSARLSWNLEQSTFDSF LIQYQESEKVGEAIVLTVPGSERSYDLTGLKP GTEYTVSIYGVTTYRITVPVRDHSNPLSAIFTT |
| 552 | PRT | Artificial | Luk673 LukS binding FN3 domain | LPAPKNLVVSRVTEDSARLSWRAAGTGFDSF LIQYQESEKVGEAIVLTVPGSERSYDLTGLKP GTEYTVSIYGVNWQPDYWTWPSNPLSAIFTT |
| 553 | PRT | Artificial | Luk674 HlgC binding FN3 domain | LPAPKNLVVSRVTEDSARLSWPISHLSFDSFLI QYQESEKVGEAIVLTVPGSERSYDLTGLKPG TEYTVSIYGVWHQTVGRWFSNPLSAIFTT |
| 554 | PRT | Artificial | Luk675 HlgC binding FN3 domain | LPAPKNLVVSRVTEDSARLSWVRKKVNRFDS FLIQYQESEKVGEAIVLTVPGSERSYDLTGLK PGTEYTVSIYGVRNWKPNDPSNPLSAIFTT |
| 555 | PRT | Artificial | Luk676 HlgC binding FN3 domain | LPAPKNLVVSRVTEDSARLSWVSATQHPFDS FLIQYQESEKVGEAIVLTVPGSERSYDLTGLK PGTEYTVSIYGVDNWDPTDPSNPLSAIFTT |
| 556 | PRT | Artificial | Luk677 HlgC binding FN3 domain | LPAPKNLVVSRVTEDSARLSWPIALRDFDSFL IQYQESEKVGEAIVLTVPGSERSYDLTGLKPG TEYTVSIYGVISWDPTDPSNPLSAIFTT |
| 557 | PRT | Artificial | Luk678 HlgC binding FN3 domain | LPAPKNLVVSRVTEDSARLSWWDAEWFAPH FDSFLIQYQESEKVGEAIVLTVPGSERSYDLT GLKPGTEYTVSIYGVGLLKWPNYAVLSNPLS AIFTT |
| 558 | PRT | Artificial | Luk679 HlgC binding FN3 domain | LPAPKNLVVSRVTEDSARLSWPNNQRYYQPF DSFLIQYQESEKVGEAIVLTVPGSERSYDLTG LKPGTEYTVSIYGVLSWNPHHWSNPLSAIFTT |
| 559 | PRT | Artificial | Luk680 HlgC binding FN3 domain | LPAPKNLVVSRVTEDSARLSWYDARVTDEFF DSFLIQYQESEKVGEAIVLTVPGSERSYDLTG LKPGTEYTVSIYGVDDLLTNHLLAISNPLSAIF TT |
| 560 | PRT | Artificial | Luk681 HlgC binding FN3 domain | LPAPKNLVVSRVTEDSARLSWKKRNTLKIFD SFLIQYQESEKVGEAIVLTVPGSERSYDLTGL KPGTEYTVSIYGVETWDPNDWSNPLSAIFTT |
| 561 | PRT | Artificial | Luk682 HlgC binding FN3 domain | LPAPKNLVVSRVTEDSARLSWLNRVKPNDFD SFLIQYQESEKVGEAIVLTVPGSERSYDLTGL KPGTEYTVSIYGVITWHPGHWSNPLSAIFTT |
| 562 | PRT | Artificial | Luk683 LukD binding FN3 domain | LPAPKNLVVSRVTEDSARLSWLTVRFTKFEF DSFLIQYQESEKVGEAIVLIVPGSERSYDLTGL KPGTEYTVSIYGVRSSKPRASNPLSAIFTT |

TABLE 6-continued

Nucleic Acid and Amino Acid Sequences of the Disclosure

| SEQ ID NO: | Type | Species | Description | Sequence |
|---|---|---|---|---|
| 563 | PRT | Artificial | Luk684 HlgC binding FN3 domain | LPAPKNLVVSRVTEDSARLSWPNYRKVVSVF DSFLIQYQESEKVGEAIVLTVPGSERSYDLTG LKPGTEYTVSIYGVHTWHPGHYSNPLSAIFTT |
| 564 | PRT | Artificial | Luk685 HlgC binding FN3 domain | LPAPKNLVVSRVTEDSARLSWGNRQQVRSAF DSFLIQYQESEKVGEAIVLTVPGSERSYDLTG LKPGTEYTVSIYGVVGWHPNHPSNPLSAIFTT |
| 565 | PRT | Artificial | Luk686 HlgC binding FN3 domain | LPARKTWLFLVLPKTLRVCLGPRRTRRSTLF GLRTQRLLSGGKRLACWCRVLNVLTT |
| 566 | PRT | Artificial | Luk687 HlgC, LukS binding FN3 domain | LPARKTWLFLVLPKTLRVCLGPRRTRRSTLS GLHTQRRHPGVKRSA |
| 567 | PRT | Artificial | Luk688 HlgC binding FN3 domain | LPAPKNLVVSRVTEDSARLSWTAPDAAFDSF GIEGGEYYYVGEAIVLTVPGSERSYDLTGLKP GTEYGVPIGGVKGGPNSHPLSAIFTT |
| 568 | PRT | Artificial | Luk689 LukD, LukAB binding FN3 domain | LPAPKNLVVSRVTEDSARLSWWFYLTSWFAF DSFLIQYQESEKVGEAIVLTVPGSERSYDLTG LKPGTEYTVSIYGVLKVDPHVRSNPLSAIFTT |
| 569 | PRT | Artificial | Luk690 HlgB binding FN3 domain | LPAPKNLVVSRVTEDSARLSWYHVNFGFFDS FLIQYQESEKVGEAIVLTVPGSERSYDLTGLK PGTEYTVSIYGVYEDYPVIIFNNRSNPLSAIFTT |
| 570 | PRT | Artificial | Luk691 LukF binding FN3 domain | LPAPKNLVVSRVTEDSARLSWEDIKNKRFDS FLIQYQESEKVGEAIVLTVPGSERSYDLTGLK PGTEYTVSIYGVRGLANPFRVSNPLSAIFTT |
| 571 | PRT | Artificial | Luk692 HlgB, LukD binding FN3 domain | LPAPKNLVVSRVTEDSARLSWWRYGPWFHF DSFLIQYQESEKVGEAIVLTVPGSERSYDLTG LKPGTEYTVSIYGVRTHVRPPQWVSNPLSAIF TT |
| 572 | PRT | Artificial | Luk693 HlgB, LukD binding FN3 domain | LPAPKAAVVSRVTEDSARLSWWRYGPWFHF DSFLIQYQESEKVGEAIVLTVPGSERSYDLTG LKPGTEYTVSIYGVRTHVRPPQWVSNPLSAIF TT |
| 573 | PRT | Artificial | Luk694 HlgB binding FN3 domain | LPAPKNLVVSRVTEDSARLSWTNYYLESRHF DSFLIQYQESEKVGEAIVLTVPGSERSYDLTG LKPGTEYTVSIYGVRGQFGWYIEASNPLSAIF TT |
| 574 | PRT | Artificial | Luk695 LukD, LukAB binding FN3 domain | LPAPKNLVVSRVTEDSARLSWLNWEQYITFD SFLIQYQESEKVGEAIVLTVPGSERSYDLTGL KPGTEYTVSIYGVWIIRDRSHWLNPSNPLSAI FTT |
| 575 | PRT | Artificial | Luk696 HlgB binding FN3 domain | LPAPKNLWLFLVLPKTLPVCLGGVMARGSTS TLS |
| 576 | PRT | Artificial | Luk697 HlgB binding FN3 domain | LPAPKNLVVSRVTEDSARLSWERFGPWFHFD SFLIQYQESEKVGEAIVLTVPGSERSYDLTGL KPGTEYTVSIYGVKTQPEQEFKSNPLSAIFTT |
| 577 | PRT | Artificial | Luk698 HlgB binding FN3 domain | LPAPKNLVVSRVTEDSARLSWWRYGPWFHF DSFLIQYQESEKVGEAIVLTVPGSERSYDLTG LKPGTEYTVSIYGVRTHVRPPQWISYPLSAIFTT |
| 578 | PRT | Artificial | Luk699 HlgB binding FN3 domain | LPAPKNLVVSRVTEDSARLSWWRYGPWFHF DSFLIQYQESEKVGEAIVLTVPGSERSYDLTG LKPGTEYTVSIYGVKQHHSLFHSNPLSAIFTT |
| 579 | PRT | Artificial | Luk700 LukD binding FN3 domain | LPAPKNLVVSRVTEDSARLSWNQQLNYQYF DSFLIQYQESEKVGEAIVLTVPGSERSYDLTG LKPGTEYTVSIYGVWYRWWSGSNPLSAIFTT |

TABLE 6-continued

Nucleic Acid and Amino Acid Sequences of the Disclosure

| SEQ ID NO: | Type | Species | Description | Sequence |
|---|---|---|---|---|
| 580 | PRT | Artificial | Luk701 HlgB binding FN3 domain | LPAPKNLVVSRVTEDSARLSWWRYGPWFHF DSFLIQYQESEKVGEAIVLTVPGSERSYDLTG LKPGTEYTVSIYGVRTHNNQPGHYTSNPLSAI FTT |
| 581 | PRT | Artificial | Luk702 HlgB binding FN3 domain | LPAPKNLVVSRVTEDSARLSWWRYGPWFHF DSFLIQYQESEKVGEAIVLTVPGSERSYDLTG LKPGTEYTVSIYGVRTHVRPPQWVSNPLSAIF TT |
| 582 | PRT | Artificial | Luk703 HlgB, LukD binding FN3 domain | LPAPKALVVSRVTEDSARLSWWRYGPWFHF DSFLIQYQESEKVGEAIVLTVPGSERSYDLTG LKPGTEYTVSIYGVRTHVRPPQWVSNPLSAIF TT |
| 583 | PRT | Artificial | Luk704 LukD binding FN3 domain | LPAPKNLVVSRVTEDSARLSWTAPDAAFDSF PILYQERWWKGEAIVLTVPGSERSYDLTGLK PGTEYGVPITGVKGGGVSFPLSAIFTT |
| 584 | PRT | Artificial | Luk705 LukAB binding FN3 domain | LPAPKNLVVSRVTEDSARLSWTAPDAAFDSF HIWYRESWYFGEAIVLTVPGSERSYDLTGLK PGTEYYVVIRGVKGGSLSWPLSAIFTT |
| 585 | PRT | Artificial | Luk706 HlgB binding FN3 domain | LPAPKNLVVSRVTEDSARLSWTAPDAAFDSF PISYYEQPRRGEAIWLFVPGSERSYDLTGLKP GTEYTVYITGVKGGTWSFPLTATFTT |
| 586 | PRT | Artificial | Luk707 LukE binding FN3 domain | LPAPKNLVVSRVTEDSARLSWTAPDAAFDSF GIEYYETKTKGEAINLFVPGSERSYDLTGLKP GTEYYVIILGVKGGEPSSPLVAPFTT |
| 587 | PRT | Artificial | Luk708 LukAB binding FN3 domain | LPAPKNLVVSRVTEDSARLSWKDVGEWKFD SFLIQYQESEKVGEAIVLTVPGSERSYDLTGL KPGTEYTVSIYGVHQLTITYSPTSNPLSAIFTT |
| 588 | PRT | Artificial | Luk709 LukAB binding FN3 domain | LPAPKNLVVSRVTEDSARLSWKRSYHPNFDS FLIQYQESEKVGEAIVLTVPGSERSYDLTGLK PGTEYTVSIYGVIDVPTVYHPGRSNPLSAIFTT |
| 589 | PRT | Artificial | Luk710 LukAB binding FN3 domain | LPAPKNLVVSRVTEDSARLSWLKKVSKFDSF LIQYQESEKVGEAIVLTVPGSERSYDLTGLKP GTEYTVSIYGVGEFPDRIYWGASNPLSAIFTT |
| 590 | PRT | Artificial | Luk711 LukAB binding FN3 domain | LPAPKNLVVSRVTEDSARLSWYYWVQTIFDS FLIQYQESEKVGEAIVLTVPGSERSYDLTGLK PGTEYTVSIYGVGNLPDIFYKLPSNPLSAIFTT |
| 591 | PRT | Artificial | Luk712 LukAB binding FN3 domain | LPAPKNLVVSRVTEDSARLSWSKKLENFDSF LIQYQESEKVGEAIVLTVPGSERSYDLTGLKP GTEYTVSIYGVHTHLIFSNPLSAIFTT |
| 592 | PRT | Artificial | Luk713 LukAB binding FN3 domain | LPAPKNLVVSRVTEDSARLSWHDLTIWPFDS FLIQYQESEKVGEAIVLTVPGSERSYDLTGLK PGTEYTVSIYGVVIEFEAWSNPLSAIFTT |
| 593 | PRT | Artificial | Luk714 LukAB binding FN3 domain | LPAPKNLVVSRVTEDSARLSWFPWTEWSAFD SFLIQYQESEKVGEAIVLTVPGSERSYDLTGL KPGTEYTVSIYGVENWLVLATATWSNPLSAI FTT |
| 594 | PRT | Artificial | Luk715 LukAB binding FN3 domain | LPAPKNLVVSRVTEDSARLSWVEWWIRPIEF DSFLIQYQESEKVGEAIVLTVPGSERSYDLTG LKPGTEYTVSIYGVWQQLYVEILISNPLSAIFTT |
| 595 | PRT | Artificial | Luk716 LukAB binding FN3 domain | LPAPKNLVVSRVTEDSARLSWSSQRTLPREF DSFLIQYQESEKVGEAIVLTVPGSERSYDLTG LKPGTEYTVSIYGVHVIIHSGSSNPLSAIFTT |
| 596 | PRT | Artificial | Luk717 LukAB binding FN3 domain | LPAPKNLVVSRVTEDSARLSWTSRLEDFWFD SFLIQYQESEKVGEAIVLTVPGSERSYDLTGL KPGTEYTVSIYGVGSEVYFRYYEHWSNPLSAI FTT |

TABLE 6-continued

Nucleic Acid and Amino Acid Sequences of the Disclosure

| SEQ ID NO: | Type | Species | Description | Sequence |
|---|---|---|---|---|
| 597 | PRT | Artificial | Luk718 LukAB binding FN3 domain | LPAPKNLVVSRVTEDSARLSWQVNRNAQFH FDSFLIQYQESEKVGEAIVLTVPGSERSYDLT GLKPGTEYTVSIYGVAHPKLVWFAPPSNPLS AIFTT |
| 598 | PRT | Artificial | Luk719 LukAB binding FN3 domain | LPAPKNLVVSRVTEDSARLSWTFLEKWFIFDS FLIQYQESEKVGEAIVLTVPGSERSYDLTGLK PGTEYTVSIYGVVKHHDHDPEYPSNPLSAIFTT |
| 599 | PRT | Artificial | Luk720 LukAB binding FN3 domain | LPAPKNLVVSRVTEDSARLSWRHPRIQGGHF DSFLIQYQESEKVGEAIVLTVPGSERSYDLTG LKPGTEYTVSIYGVIHPFWWSPSNPLSAIFTT |
| 600 | PRT | Artificial | Luk721 LukAB binding FN3 domain | LPAPKNLVVSRVTEDSARLSWYNAKKITPFF DSFLIQYQESEKVGEAIVLTVPGSERSYDLTG LKPGTEYTVSIYGVYPEVQHTTSNPLSAIFTT |
| 601 | PRT | Artificial | Luk722 LukAB binding FN3 domain | LPAPKNLVVSRVTEDSARLSWTEPWQEFDSF LIQYQESEKVGEAIVLTVPGSERSYDLTGLKP GTEYTVSIYGVILPTLHKSNPLSAIFTT |
| 602 | PRT | Artificial | Luk723 LukAB binding FN3 domain | LPAPKNLVVSRVTEDSARLSWYRFPRIHFDSF LIQYQESEKVGEAIVLTVPGSERSYDLTGLKP GTEYTVSIYGVHTNIDLHNYNYLSNPLSAIFTT |
| 603 | PRT | Artificial | Luk724 LukAB binding FN3 domain | LPAPKNLVVSRVTEDSARLSWAERHPWFDSF LIQYQESEKVGEAIVLTVPGSERSYDLTGLKP GTEYTVSIYGVLRQNINIQDTNYSNPLSAIFTT |
| 604 | PRT | Artificial | Luk725 LukAB binding FN3 domain | LPAPKNLVVSRVTEDSARLSWPWWEGWTFD SFLIQYQESEKVGEAIVLTVPGSERSYDLTGL KPGTEYTVSIYGVKIRTLKASRSNPLSAIFTT |
| 605 | PRT | Artificial | Luk726 LukAB binding FN3 domain | LPAPKNLVVSRVTEDSARLSWAANFIDFDSFL IQYQESEKVGEAIVLTVPGSERSYDLTGLKPG TEYTVSIYGVYSPKLRWDLLNYSNPLSAIFTT |
| 606 | PRT | Artificial | Luk727 LukAB binding FN3 domain | LPAPKNLVVSRVTEDSARLSWFKQEFEFDSFL IQYQESEKVGEAIVLTVPGSERSYDLTGLKPG TEYTVSIYGVYYPEYYPREPWPSNPLSAIFTT |
| 607 | PRT | Artificial | Luk728 LukAB binding FN3 domain | LPAPKNLVVSRVTEDSARLSWEDEGTQFDSF LIQYQESEKVGEAIVLTVPGSERSYDLTGLKP GTEYTVSIYGVHWYWYWQRSNPLSAIFTT |
| 608 | PRT | Artificial | Luk729 LukAB binding FN3 domain | LPAPKNLVVSRVTEDSARLSWFGNQTGARSF DSFLIQYQESEKVGEAIVLTVPGSERSYDLTG LKPGTEYTVSIYGVYYQFRRTVRNSNPLSAIF TT |
| 609 | PRT | Artificial | Luk730 LukAB binding FN3 domain | LPAPKNLVVSRVTEDSARLSWGENRFVLSFD SFLIQYQESEKVGEAIVLTVPGSERSYDLTGL KPGTEYTVSIYGVLYHARHTWWLQQSNPLS AIFTT |
| 610 | PRT | Artificial | Luk731 LukAB binding FN3 domain | LPAPKNLVVSRVTEDSARLSWEKQQLKKWS FDSFLIQYQESEKVGEAIVLTVPGSERSYDLT GLKPGTGYTVSIYGVEHSNTRKRHSNPLSAIF TT |
| 611 | PRT | Artificial | Luk732 LukAB binding FN3 domain | LPAPKNLVVSRVTEDSARLSWKINDNSGYFD SFLIQYQESEKVGEAIVLTVPGSERSYDLTGL KPGTEYTVSIYGVAHRYENNPTLWSNPLSAIF TT |
| 612 | PRT | Artificial | Luk733 LukAB binding FN3 domain | LPAPKNLVVSRVTEDSARLSWPAFRWQPPGF DSFLIQYQESEKVGEAIVLTVPGSERSYDLTG LKPGTEYTVSIYGVGGFLYPWNYPTSNPLSAI FTT |
| 613 | PRT | Artificial | Luk734 LukAB binding FN3 domain | LPAPKNLVVSRVTEDSARLSWISEKPTTSLFD SFLIQYQESEKVGEAIVLTVPGSERSYDLTGL KPGTEYTVSIYGVWPRAIHYAYWFNSNPLSA IFTT |

TABLE 6-continued

Nucleic Acid and Amino Acid Sequences of the Disclosure

| SEQ ID NO: | Type | Species | Description | Sequence |
|---|---|---|---|---|
| 614 | PRT | Artificial | Luk735 LukAB binding FN3 domain | LPAPKNLVVSRVTEDSARLSWQKSFQLTPFD SFLIQYQESEKVGEAIVLTVPGSERSYDLTGL KPGTEYTVSIYGVVVEYKWAATNPSNPLSAI FTT |
| 615 | PRT | Artificial | Luk736 LukAB binding FN3 domain | LPAPKNLVVSRVTEDSARLSWNASLNANHFD SFLIQYQESEKVGEAIVLTVPGSERSYDLTGL KPGTEYTVSIYGVVTSESNYGSNPLSAIFTT |
| 616 | PRT | Artificial | Luk737 LukAB binding FN3 domain | LPAPKNLVVSRVTEDSARLSWTNTARLNKFD SFLIQYQESEKVGEAIVLTVPGSERSYDLTGL KPGTEYTVSIYGVAITHSHHHHSSNPLSAIFTT |
| 617 | PRT | Artificial | Luk738 LukAB binding FN3 domain | LPAPKNLVVSRVTEDSARLSWTAPDAAFDSF HILYWEPTPIGEAILLNVPGSERSYDLTGLKP GTEYNVEIDGVKGGNPSDPLSAIFTT |
| 618 | PRT | Artificial | Luk739 LukAB binding FN3 domain | LPAPKNLVVSRVTEDSARLSWTAPDAAFDSF SISYREGGQHGEAIVLTVPGSERSYDLTGLKP GTEYSVYILGVKGGDESEPLSAIFTT |
| 619 | PRT | Artificial | Luk740 LukAB binding FN3 domain | LPAPKNLVVSRVTEDSARLSWPWWNKHFDS FLIQYQESEKVGEAIVLTVPGSERSYDLTGLK PGTEYTVSIYGVIQWKKKPFSNPLSAIFTT |
| 620 | PRT | Artificial | Luk741 LukAB binding FN3 domain | LPAPKNLVVSRVTEDSARLSWPWWNKHFDS FLIQYQESEKVGEAIVLTVPGSERSYDLTGLK PGTEYTVSIYGVGEHDWYLLNYAESNPLSAIF TT |
| 621 | PRT | Artificial | Luk742 LukAB binding FN3 domain | LPAPKNLVVSRVTEDSARLSWWAFSYLQFDS FLIQYQESEKVGEAIVLTVPGSERSYDLTGLK PGTEYTVSIYGVVEVRENSWNHSSNPLSAIFTT |
| 622 | PRT | Artificial | Luk743 LukAB binding FN3 domain | LPAPKNLVVSRVTEDSARLSWRETHNPQFDS FLIQYQESEKVGEAIVLTVPGSERSYDLTGLK PGTEYTVSIYGVIQWKKKPFSNPLSAIFTT |
| 623 | PRT | Artificial | Luk744 LukAB binding FN3 domain | LPAPKNLVVSRVTEDSARLSWTTRVDEFDSF LIQYQESEKVGEAIVLTVPGSERSYDLTGLKP GTEYTVSIYGVKWYNWKKNVNTESNPLSAIF TT |
| 624 | PRT | Artificial | Luk745 LukAB binding FN3 domain | LPAPKNLVVSRVTEDSARLSWSQKDINFFDSF LIQYQESEKVGEAIVLTVPGSERSYDLTGLKP GTEYTVSIYGVLWYNWKKNWDNSNPLSAIF TT |
| 625 | PRT | Artificial | Luk746 LukAB binding FN3 domain | LPAPKNLVVSRVTEDSARLSWFTTNNHWFDS FLIQYQESEKVGEAIVLTVPGSERSYDLTGLK PGTEYTVSIYGVIQWKKKPFSNPLSAIFTT |
| 626 | PRT | Artificial | Luk747 LukAB binding FN3 domain | LPAPKNLVVSRVTEDSARLSWGRAREPASFD SFLIQYQESEKVGEAIVLTVPGSERSYDLTGL KPGTEYTVSIYGVLTVLFIDSSNPLSAIFTT |
| 627 | PRT | Artificial | Luk748 LukAB binding FN3 domain | LPAPKNLVVSRVTEDSVRLSWYNWKKKRLK FDSFLIQYQESEKVGEAIVLTVPGSERSYDLT GLKPGTEYTVSIYGVPNLWDIWNWVLSNPLS AIFTT |
| 628 | PRT | Artificial | Luk749 LukAB binding FN3 domain | LPAPKNLVVSRVTEDSARLSWGTFNLEVYIF DSFLIQYQESEKVGEAIVLTVPGSERSYDLTG LKPGTEYTVSIYGVVSANWHGHSNPLSAIFTT |
| 629 | PRT | Artificial | Luk750 LukAB binding FN3 domain | LPAPKNLVVSRVTEDSARLSWPQIFNELWEF DSFLIQYQESEKVGEAIVLTVPGSERSYDLTG LKPGTEYTVSIYGVWWYNRKKKRQSNPLSAI FTT |
| 630 | PRT | Artificial | Luk751 LukAB binding FN3 domain | LPAPKNLVVSRVTEDSARLSWYNEQKKPINF DSFLIQYQESEKVGEAIVLTVPGSERSYDLTG LKPGTEYTVSIYGVWWYNRKKKRQSNPLSAI FTT |

TABLE 6-continued

Nucleic Acid and Amino Acid Sequences of the Disclosure

| SEQ ID NO: | Type | Species | Description | Sequence |
|---|---|---|---|---|
| 631 | PRT | Artificial | Luk752 LukAB binding FN3 domain | LPAPKNLVVSRVTEDSARLSWRGKYSVVDF DSFLIQYQESEKVGEAIVLTVPGSERSYDLTG LKPGTEYTVSIYGVPWYNWKKKYVISNPLSA IFTT |
| 632 | PRT | Artificial | Luk753 LukAB binding FN3 domain | LPAPKNLVVSRVTEDSARLSWYNTKKNPVFD SFLIQYQESEKVGEAIVLTVPGSERSYDLTGL KPGTEYTVSIYGVWLIKSLNAWFSNPLSAIFTT |
| 633 | PRT | Artificial | Luk754 LukAB binding FN3 domain | LPAPKNLVVSRVTEDSARLSWTAPDAAFDSF VIIYEEVQWRGEAIRLFVPGSERSYDLTGLKP GTEYDVNIRGVKGGGSSAPLSAIFTT |
| 634 | PRT | Artificial | Luk755 LukAB binding FN3 domain | LPAPKNLVVSRVTEDSARLSWYNWKKKPGY FDSFLIQYQESEKVGEAIVLTVPGSERSYDLT GLKPGTEYTVSIYGVVHYHEWLASNPLSAIFTT |
| 635 | PRT | Artificial | Luk756 LukAB binding FN3 domain | LPAPKNLVVSRVTEDSARLSWYTVKKKPQKF DSFLIQYQESEKVGEAIVLTVPGSERSYDLTG LKPGTEYTVSIYGVLDAYPIAEWPAQSNPLSA IFTT |
| 636 | PRT | Artificial | Luk757 LukAB binding FN3 domain | LPAPKNLVVSRVTEDSARLSWYNTKKKPQFD SFLIQYQESEKVGEAIVLTVPGSERSYDLTGL KPGTEYTVSIYGVNEFILRWEGSNPLSAIFTT |
| 637 | PRT | Artificial | Luk758 LukAB binding FN3 domain | LPAPKNLVVSRVTEDSARLSWTAPDAAFDSF YIGYYELIGAGEAIVLTVPGSERSYDLTGLKP GTEYGVGIQGVKGGSYSAPLSAIFTT |
| 638 | PRT | Artificial | Luk759 LukAB binding FN3 domain | LPAPKNLVVSRVTEDSARLSWYDRKVEFDSF LIQYQESEKVGEAIVLTVPGSERSYDLTGLKP GTEYTVSIYGVDGWGYLLLVSNPLSAIFTT |
| 639 | PRT | Artificial | Luk760 LukAB binding FN3 domain | LPAPKNLVVSRVTEDSARLSWIVPRTFHFDSF LIQYQESEKVGEAIVLTVPGSERSYDLTGLKP GTEYTVSIYGVWSQYITHWLPKSNPLSAIFTT |
| 640 | PRT | Artificial | Luk761 LukAB binding FN3 domain | LPAPKNLVVSRVTEDSARLSWNYRVATFDSF LIQYQESEKVGEAIVLTVPGSERSYDLTGLKP GTEYTVSIYGVSVELLSSNPLSAIFTT |
| 641 | PRT | Artificial | Luk762 LukAB binding FN3 domain | LPAPKNLVVSRVTEDSARLSWQPHRYEFYQF DSFLIQYQESEKVGEAIVLTVPGSERSYDLTG LKPGTEYTVSIYGVADFEFELHSNPLSAIFTT |
| 642 | PRT | Artificial | Luk763 LukAB binding FN3 domain | LPAPKNLVVSRVTEDSARLSWIPSYHLFAFDS FLIQYQESEKVGEAIVLTVPGSERSYDLTGLK PGTEYTVSIYGVNDAEQRYHHSNPLSAIFTT |
| 643 | PRT | Artificial | Luk764 LukAB binding FN3 domain | LPAPKNLVVSRVTEDSARLSWPINKTTSPFDS FLIQYQESEKVGEAIVLTVPGSERSYDLTGLK PGTEYTVSIYGVVEAHYDAFISNPLSAIFTT |
| 644 | PRT | Artificial | Luk765 LukAB binding FN3 domain | LPAPKNLVVSRVTEDSARLSWRKKLWEAEF DSFLIQYQESEKVGEAIVLTVPGSERSYDLTG LKPGTEYTVSIYGVILPDSFHVHHCNPLSAIFTT |
| 645 | PRT | Artificial | Luk766 LukAB binding FN3 domain | LPAPKNLVVSRVTEDSARLSWKRPQWRRLF DSFLIQYQESEKVGEAIVLTVPGSERSYDLTG LKPGTEYTVSIYGVGVNWPASVSSNPLSAIFTT |
| 646 | PRT | Artificial | Luk767 LukAB binding FN3 domain | LPAPKNLVVSRVTEDSARLSWIWDAIGPHFF DSFLIQYQESEKVGEAIVLTVPGSERSYDLTG LKPGTEYTVSIYGVSWFIRITASNPLSAIFTT |
| 647 | PRT | Artificial | Luk768 LukAB binding FN3 domain | LPAPKNLVVSRVTEDSARLSWRGLEPRWGFD SFLIQYQESEKVGEAIVLTVPGSERSYDLTGL KPGTEYTVSIYGVPWYEHLRILNATSNPLSAI FTT |

TABLE 6-continued

Nucleic Acid and Amino Acid Sequences of the Disclosure

| SEQ ID NO: | Type | Species | Description | Sequence |
|---|---|---|---|---|
| 648 | PRT | Artificial | Luk769 LukAB binding FN3 domain | LPAPKNLVVSRVTEDSARLSWDWWSNPIKFD SFLIQYQESEKVGEAIVLTVPGSERSYDLTGL KPGTEYTVSIYGVINWHWYQTHRTSNPLSAIF TT |
| 649 | PRT | Artificial | Luk770 LukAB binding FN3 domain | LPAPKNLVVSRVTEDSARLSWEQWHAGVNP FDSFLIQYQESEKVGEAIVLTVPGSERSYDLT GLKPGTEYTVSIYGVSYYVRVLQFALFSNPLS AIFTT |
| 650 | PRT | Artificial | Luk771 LukAB binding FN3 domain | LPAPKNLVVSRVTEDSARLSWAQVETQIHFD SFLIQYQESEKVGESDLLTVPGSERSYDLTGL KPGTEYTVSIYGVSHYRRHVPRHSNPLSAIFTT |
| 651 | PRT | Artificial | Luk772 LukAB binding FN3 domain | LPAPKNLVVSRVTEDSARLSWIAYYYGQTFD SFLIQYQESEKVGEAIVLTVPGSERSYDLTGL KPGTEYTVSIYGVWHENYAKWPDPSNPLSAI FTT |
| 652 | PRT | Artificial | Luk773 LukAB binding FN3 domain | LPAPKNLVVSRVTEDSARLSWWHWLTHHFF DSFLIQYQESEKVGEAIVLTVPGSERSYDLTG LKPGTEYTVSIYGVFFRWQDPLHDLISNPLSA IFTT |
| 653 | PRT | Artificial | Luk774 LukAB binding FN3 domain | LPAPKNLVVSRVTEDSARLSWKYKEHFQIFD SFLIQYQESEKVGEAIVLTVPGSERSYDLTGL KPGTEYTVSIYGVERIWWQYRSNPLSAIFTT |
| 654 | PRT | Artificial | Luk775 LukAB binding FN3 domain | LPAPKNLVVSRVTEDSARLSWVGDAYFNHLF DSFLIQYQESEKVGEAIVLTVPGSERSYDLTG LKPGTEYTVSIYGVEARPKPRLSNPLSAIFTT |
| 655 | PRT | Artificial | Luk776 LukAB binding FN3 domain | LPAPKNLVVSRVTEDSARLSWNKRVPNFDSF LIQYQESEKVGEAIVLTVPGSERSYDLTGLKP GTEYTVSIYGVIQWKKKPFSNPLSAIFTT |
| 656 | PRT | Artificial | Luk777 LukAB binding FN3 domain | LPAPKNLVVSRVTEDSARLSWYNEQKKRSFF DSFLIQYQESEKVGEAIVLTVPGSERSYDLTG LKPGTEYTVSIYGVPIRRSGWDVRSNPLSAIF TT |
| 657 | PRT | Artificial | Luk778 LukAB binding FN3 domain | LPAPKNLVVSRVTEDSARLSWYNTKKKPVFD SFLIQYQESEKVGEAIVLTVPGSERSYDLTGL KPGTEYTVSIYGVKVDDWPDYWQSNPLSAIF TT |
| 658 | PRT | Artificial | Luk779 LukAB binding FN3 domain | LPAPKNLVVSRVTEDSARLSWYNVKKTFQFD SFLIQYQESEKVGEAIVLTVPGSERSYDLTGL KPGTEYTVSIYGVAAVWYTPNTQSNPLSAIFTT |
| 659 | PRT | Artificial | Luk780 LukAB binding FN3 domain | LPAPKNLVVSRVTEDSARLSWYNSKKKVQF DSFLIQYQESEKVGEAIVLTVPGSERSYDLTG LKPGTEYTVSIYGVIESHWWQLKWPSNPLSAI FTT |
| 660 | PRT | Artificial | Luk781 LukAB binding FN3 domain | LPAPKNLVVSRVTEDSARLSWYNTKKKTAFF DSFLIQYQESEKVGEAIVLTVPGSERSYDLTG LKPGTEYTVSIYGVDEVGYLHIETSNPLSAIFTT |
| 661 | PRT | Artificial | Luk782 LukAB binding FN3 domain | LPAPKNLVVSRVTEDSARLSWYNEKKIFQFD SFLIQYQESEKVGEAIVLTVPGSERSYDLTGL KPGTEYTVSIYGAKGPNFPSQNDPSSNPLSAIF TT |
| 662 | PRT | Artificial | Luk783 LukAB binding FN3 domain | LPAPKNLVVSRVTEDSARLSWYNWKKKRLK FDSFLIQYQESEKVGEAIVLTVPGSERSYDLT GLKPGTEYTVSIYGVASPVYTGLYLGSNPLSA IFTT |
| 663 | PRT | Artificial | Luk784 LukAB binding FN3 domain | LPAPKNLVVSRVTEDSARLSWYTVKKKPQKF DSFLIQYQESEKVGEAIVLTVPGSERSYDLTG LKPGTEYTVSIYGVGDQLLEIGRTGSNPLSAIF TT |

TABLE 6-continued

Nucleic Acid and Amino Acid Sequences of the Disclosure

| SEQ ID NO: | Type | Species | Description | Sequence |
|---|---|---|---|---|
| 664 | PRT | Artificial | Luk785 LukAB binding FN3 domain | LPAPKNLVVSRVTEDSARLSWTAPDAAFDSF FIGYREVPFLGEAIVLTVPGSERSYDLTGLKP GTEYIVLIWGVKGGIPSQPLSAIFTT |
| 665 | PRT | Artificial | Luk786 LukAB binding FN3 domain | LPAPKNLVVSRVTEDSARLSWTAPDAAFDSF FIPYREEAPLGEAIVLTVPGSERSYDLTGLKPG TEYDVIIVGVKGGYPSKPLSAIFTT |
| 666 | PRT | Artificial | Luk787 LukAB binding FN3 domain | LPAPKNLVVSRVTEDSARLSWTAPDAAFDSF WIVYHELVHSGEAIVLTVPGSERSYDLTGLKP GTEYPVFIVGVKGGWYSPPLSAIFTT |
| 667 | PRT | Artificial | TCL24 | LPAPKNLVVSRVTEDSARLSWTAPDAAFDSF XIXYXEXXXXGEAIXLXVPGSERSYDLTGLK PGTEYXVXIXGVKGGXXSXPLXAXFTT |
| 668 | PRT | S. aureus | ClfA | GSMASENSVTQSDSASNESKSNDSSSVSAAP KTDDTNVSDTKTSSNTNNGETSVAQNPAQQE TTQSSSTNATTEETPVTGEATTTTTNQANTPA TTQSSNTNAEELVNQTSNETTFNDTNTVSSV NSPQNSTNAENVSTTQDTSTEATPSNNESAPQ STDASNKDVVNQAVNTSAPRMRAFSLAAVA ADAPAAGTDITNQLTNVTVGIDSGTTVYPHQ AGYVKLNYGFSVPNSAVKGDTFKITVPKELN LNGVTSTAKVPPIMAGDQVLANGVIDSDGNV IYTFTDYVNTKDDVKATLTMPAYIDPENVKK TGNVTLATGIGSTTANKTVLVDYEKYGKFYN LSIKGTIDQIDKTNNTYRQTIYVNPSGDNVIAP VLTGNLKPNTDSNALIDQQNTSIKVYKVDNA ADLSESYFVNPENFEDVTNSVNITFPNPNQYK VEFNTPDDQITTPYIVVVNGHIDPNSKGDLAL RSTLYGYNSNIIWRSMSWDNEVAPNNGSGSG DGIDKPVVPEQPDEPGEIEPIPEDSDSDPGSDS GSDSNSDSGSDSGSDSTSDSGSDSASDSDSAS DSDSASDSASDSDSASDSDSDNDSDSDSDS DSDSDSDSDSDSDSDSDSDSDSDSDSDSDS DSDSDSDSDSDSDSDSDSDSDSDSDSDSDS DSDSDSDSDSDSDSDSDSDSDSDSDSDSDS DSDSDSDSDSDSDSDSDSDSDSDSDSDSDS DSDSASDSDSDSDSDSDSDSDSDSDSDSDS DSDSDSDSDSDSDSESDSDSESDSDSDSDS DSDSDSDSDSASDSDSGSDSDSSSDSDSES DSNSDSESGSNNNVVPPNSPKNGTNASNKNE AKDSKEPLPDTLEHHHHHH |
| 669 | PRT | S. aureus | ClfB | GSMASEQSNDTTQSSKNNASADSEKNNMIET PQLNTTANDTSDISANTNSANVDSTTKPMST QTSNTTTTEPASTNETPQPTAIKNQATAAKM QDQTVPQEANSQVDNKTTNDANSIATNSELK NSQTLDLPQSSPQTISNAQGTSKPSVRTRAVR SLAVAEPVVNAADAKGTNVNDKVTASNFKL EKTTFDPNQSGNTFMAANFTVTDKVKSGDY FTAKLPDSLTGNGDVDYSNSNNTMPIADIKST NGDVVAKATYDILTKTYTFVFTDYVNNKENI NGQFSLPLFTDRAKAPKSGTYDANINIADEM FNNKITYNYSSPIAGIDKPNGANISSQIIGVDT ASGQNTYKQTVFVNPKQRVLGNTWVYIKGY QDKIEESSGKVSATDTKLRIFEVNDTSKLSDS YYADPNDSNLKEVTDQFKNRIYYEHPNVASI KFGDITKTYVVLVEGHYDNTGKNLKTQVIQE NVDPVTNRDYSIFGWNNENVVRYGGGSADG DSAVNPKDPTPGPPVDPEPSPDPEPEPTPDPEP SPDPEPEPSPDPDPDSDSDSDSGSDSDSGSDSD SESDSDSDSDSDSDSDSESDSDSESDSDSDS DSDSDSDSDSDSDSDSDSDSDSDSDSESDS DSDSESDSDSDSDSDSDSDSDSDSDSDSDS DSDSDSDSDSDSDSDSDSDSDSDSDSDSDS DSDSDSDSDSDSDSDSDSDSDSDSDSDSDS DSDSDSDSDSDSDSDSDSDSDSDSDSDSDS DSDSDSDSDSRVTPPNNEQKAPSNPKGEV NHSNKVSKQHKTDALPETLEHHHHHH |

TABLE 6-continued

Nucleic Acid and Amino Acid Sequences of the Disclosure

| SEQ ID NO: | Type | Species | Description | Sequence |
|---|---|---|---|---|
| 670 | PRT | Artificial | SD peptide | BIOTIN-SDSDSDSDSDSDSDSDSDSDHHHHHHHH |
| 671 | PRT | S. aureus | LukA wt | NSAHHHHHHGSHKDSQDQNKKEHVDKSQQKDKRNVTNKDKNSTAPDDIGKNGKITKRTETVYDEKTNILQNLQFDFIDDPTYDKNVLLVKKQGSIHSNLKFESHKEEKNSNWLKYPSEYHVDFQVKRNRKTEILDQLPKNKISTAKVDSTFSYSSGGKFDSTKGIGRTSSNSYSKTISYNQQNYDTIASGKNNNWHVHWSVIANDLKYGGEVKNRNDELLFYRNTRIATVENPELSFASKYRYPALVRSGFNPEFLTYLSNEKSNEKTQFEVTYTRNQDILKNRPGIHYAPPILEKNKDGQRLIVTYEVDWKNKTVKVVDKYSDDNKPYKEG |
| 672 | PRT | Artificial | Luk17W32A | LPAPKNLVVSRVTEDSARLSWTAPDAAFDSFAITYEEKFYRGEAIVLTVPGSERSYDLTGLKPGTEYKVWIVGVKGGQGSWPLSAIFTT |
| 673 | PRT | Artificial | Luk17T34A | LPAPKNLVVSRVTEDSARLSWTAPDAAFDSFWIAYEEKFYRGEAIVLTVPGSERSYDLTGLKPGTEYKVWIVGVKGGQGSWPLSAIFTT |
| 674 | PRT | Artificial | Luk17E36A | LPAPKNLVVSRVTEDSARLSWTAPDAAFDSFWITYAEKFYRGEAIVLTVPGSERSYDLTGLKPGTEYKVWIVGVKGGQGSWPLSAIFTT |
| 675 | PRT | Artificial | Luk17K38A | LPAPKNLVVSRVTEDSARLSWTAPDAAFDSFWITYEEAFYRGEAIVLTVPGSERSYDLTGLKPGTEYKVWIVGVKGGQGSWPLSAIFTT |
| 676 | PRT | Artificial | Luk17F39A | LPAPKNLVVSRVTEDSARLSWTAPDAAFDSFWITYEEKAYRGEAIVLTVPGSERSYDLTGLKPGTEYKVWIVGVKGGQGSWPLSAIFTT |
| 677 | PRT | Artificial | Luk17Y40A | LPAPKNLVVSRVTEDSARLSWTAPDAAFDSFWITYEEKFARGEAIVLTVPGSERSYDLTGLKPGTEYKVWIVGVKGGQGSWPLSAIFTT |
| 678 | PRT | Artificial | Luk17R41A | LPAPKNLVVSRVTEDSARLSWTAPDAAFDSFWITYEEKFYAGEAIVLTVPGSERSYDLTGLKPGTEYKVWIVGVKGGQGSWPLSAIFTT |
| 679 | PRT | Artificial | Luk17K68A | LPAPKNLVVSRVTEDSARLSWTAPDAAFDSFWITYEEKFYRGEAIVLTVPGSERSYDLTGLKPGTEYAVWIVGVKGGQGSWPLSAIFTT |
| 680 | PRT | Artificial | Luk17W70A | LPAPKNLVVSRVTEDSARLSWTAPDAAFDSFWITYEEKFYRGEAIVLTVPGSERSYDLTGLKPGTEYKVAIVGVKGGQGSWPLSAIFTT |
| 681 | PRT | Artificial | Luk17V72A | LPAPKNLVVSRVTEDSARLSWTAPDAAFDSFWITYEEKFYRGEAIVLTVPGSERSYDLTGLKPGTEYKVWIAGVKGGQGSWPLSAIFTT |
| 682 | PRT | Artificial | Luk17Q78A | LPAPKNLVVSRVTEDSARLSWTAPDAAFDSFWITYEEKFYRGEAIVLTVPGSERSYDLTGLKPGTEYKVWIVGVKGGAGSWPLSAIFTT |
| 683 | PRT | Artificial | Luk17G79A | LPAPKNLVVSRVTEDSARLSWTAPDAAFDSFWITYEEKFYRGEAIVLTVPGSERSYDLTGLKPGTEYKVWIVGVKGGQASWPLSAIFTT |
| 684 | PRT | Artificial | Luk17W81A | LPAPKNLVVSRVTEDSARLSWTAPDAAFDSFWITYEEKFYRGEAIVLTVPGSERSYDLTGLKPGTEYKVWIVGVKGGQGSAPLSAIFTT |
| 685 | PRT | Artificial | Luk17G42A | LPAPKNLVVSRVTEDSARLSWTAPDAAFDSFWITYEEKFYRAEAIVLTVPGSERSYDLTGLKPGTEYKVWIVGVKGGQGSWPLSAIFTT |
| 686 | PRT | Artificial | Luk17V46A | LPAPKNLVVSRVTEDSARLSWTAPDAAFDSFWITYEEKFYRGEAIALTVPGSERSYDLTGLKPGTEYKVWIVGVKGGQGSWPLSAIFTT |

TABLE 6-continued

Nucleic Acid and Amino Acid Sequences of the Disclosure

| SEQ ID NO: | Type | Species | Description | Sequence |
|---|---|---|---|---|
| 687 | PRT | Artificial | Luk17E66A | LPAPKNLVVSRVTEDSARLSWTAPDAAFDSF WITYEEKFYRGEAIVLTVPGSERSYDLTGLKP GTAYKVWIVGVKGGQGSWPLSAIFTT |
| 688 | PRT | Artificial | Luk17G77A | LPAPKNLVVSRVTEDSARLSWTAPDAAFDSF WITYEEKFYRGEAIVLTVPGSERSYDLTGLKP GTEYKVWIVGVKGAQGSWPLSAIFTT |
| 689 | PRT | Artificial | Luk17P82A | LPAPKNLVVSRVTEDSARLSWTAPDAAFDSF WITYEEKFYRGEAIVLTVPGSERSYDLTGLKP GTEYKVWIVGVKGGQGSWALSAIFTT |
| 690 | PRT | Artificial | Luk17S84A | LPAPKNLVVSRVTEDSARLSWTAPDAAFDSF WITYEEKFYRGEAIVLTVPGSERSYDLTGLKP GTEYKVWIVGVKGGQGSWPLAAIFTT |
| 691 | PRT | Artificial | Luk17I86A | LPAPKNLVVSRVTEDSARLSWTAPDAAFDSF WITYEEKFYRGEAIVLTVPGSERSYDLTGLKP GTEYKVWIVGVKGGQGSWPLSAAFTT |
| 692 | PRT | Artificial | Luk17W32S | LPAPKNLVVSRVTEDSARLSWTAPDAAFDSF SITYEEKFYRGEAIVLTVPGSERSYDLTGLKP GTEYKVWIVGVKGGQGSWPLSAIFTT |
| 693 | PRT | Artificial | Luk17T34S | LPAPKNLVVSRVTEDSARLSWTAPDAAFDSF WISYEEKFYRGEAIVLTVPGSERSYDLTGLKP GTEYKVWIVGVKGGQGSWPLSAIFTT |
| 694 | PRT | Artificial | Luk17E36S | LPAPKNLVVSRVTEDSARLSWTAPDAAFDSF WITYSEKFYRGEAIVLTVPGSERSYDLTGLKP GTEYKVWIVGVKGGQGSWPLSAIFTT |
| 695 | PRT | Artificial | Luk17K38S | LPAPKNLVVSRVTEDSARLSWTAPDAAFDSF WITYEESFYRGEAIVLTVPGSERSYDLTGLKP GTEYKVWIVGVKGGQGSWPLSAIFTT |
| 696 | PRT | Artificial | Luk17F39S | LPAPKNLVVSRVTEDSARLSWTAPDAAFDSF WITYEEKSYRGEAIVLTVPGSERSYDLTGLKP GTEYKVWIVGVKGGQGSWPLSAIFTT |
| 697 | PRT | Artificial | Luk17Y40S | LPAPKNLVVSRVTEDSARLSWTAPDAAFDSF WITYEEKFSRGEAIVLTVPGSERSYDLTGLKP GTEYKVWIVGVKGGQGSWPLSAIFTT |
| 698 | PRT | Artificial | Luk17R41S | LPAPKNLVVSRVTEDSARLSWTAPDAAFDSF WITYEEKFYSGEAIVLTVPGSERSYDLTGLKP GTEYKVWIVGVKGGQGSWPLSAIFTT |
| 699 | PRT | Artificial | Luk17K68S | LPAPKNLVVSRVTEDSARLSWTAPDAAFDSF WITYEEKFYRGEAIVLTVPGSERSYDLTGLKP GTEYSVWIVGVKGGQGSWPLSAIFTT |
| 700 | PRT | Artificial | Luk17W70S | LPAPKNLVVSRVTEDSARLSWTAPDAAFDSF WITYEEKFYRGEAIVLTVPGSERSYDLTGLKP GTEYKVSIVGVKGGQGSWPLSAIFTT |
| 701 | PRT | Artificial | Luk17V72S | LPAPKNLVVSRVTEDSARLSWTAPDAAFDSF WITYEEKFYRGEAIVLTVPGSERSYDLTGLKP GTEYKVWISGVKGGQGSWPLSAIFTT |
| 702 | PRT | Artificial | Luk17Q78S | LPAPKNLVVSRVTEDSARLSWTAPDAAFDSF WITYEEKFYRGEAIVLTVPGSERSYDLTGLKP GTEYKVWIVGVKGGSGSWPLSAIFTT |
| 703 | PRT | Artificial | Luk17G79S | LPAPKNLVVSRVTEDSARLSWTAPDAAFDSF WITYEEKFYRGEAIVLTVPGSERSYDLTGLKP GTEYKVWIVGVKGGQGSSWPLSAIFTT |
| 704 | PRT | Artificial | Luk17W81S | LPAPKNLVVSRVTEDSARLSWTAPDAAFDSF WITYEEKFYRGEAIVLTVPGSERSYDLTGLKP GTEYKVWIVGVKGGQGSSPLSAIFTT |

TABLE 6-continued

Nucleic Acid and Amino Acid Sequences of the Disclosure

| SEQ ID NO: | Type | Species | Description | Sequence |
|---|---|---|---|---|
| 705 | PRT | Artificial | Luk17G42S | LPAPKNLVVSRVTEDSARLSWTAPDAAFDSF WITYEEKFYRSEAIVLTVPGSERSYDLTGLKP GTEYKVWIVGVKGGQGSWPLSAIFTT |
| 706 | PRT | Artificial | Luk17A44S | LPAPKNLVVSRVTEDSARLSWTAPDAAFDSF WITYEEKFYRGESIVLTVPGSERSYDLTGLKP GTEYKVWIVGVKGGQGSWPLSAIFTT |
| 707 | PRT | Artificial | Luk17V46S | LPAPKNLVVSRVTEDSARLSWTAPDAAFDSF WITYEEKFYRGEAISLTVPGSERSYDLTGLKP GTEYKVWIVGVKGGQGSWPLSAIFTT |
| 708 | PRT | Artificial | Luk17E66S | LPAPKNLVVSRVTEDSARLSWTAPDAAFDSF WITYEEKFYRGEAIVLTVPGSERSYDLTGLKP GTSYKVWIVGVKGGQGSWPLSAIFTT |
| 709 | PRT | Artificial | Luk17G77S | LPAPKNLVVSRVTEDSARLSWTAPDAAFDSF WITYEEKFYRGEAIVLTVPGSERSYDLTGLKP GTEYKVWIVGVKGSQGSWPLSAIFTT |
| 710 | PRT | Artificial | Luk17P82S | LPAPKNLVVSRVTEDSARLSWTAPDAAFDSF WITYEEKFYRGEAIVLTVPGSERSYDLTGLKP GTEYKVWIVGVKGGQGSWSLSAIFTT |
| 711 | PRT | Artificial | Luk17S84S | LPAPKNLVVSRVTEDSARLSWTAPDAAFDSF WITYEEKFYRGEAIVLTVPGSERSYDLTGLKP GTEYKVWIVGVKGGQGSWPLSAIFTT |
| 712 | PRT | Artificial | Luk17I86S | LPAPKNLVVSRVTEDSARLSWTAPDAAFDSF WITYEEKFYRGEAIVLTVPGSERSYDLTGLKP GTEYKVWIVGVKGGQGSWPLSASFTT |
| 713 | PRT | Artificial | Luk17W32L | LPAPKNLVVSRVTEDSARLSWTAPDAAFDSF LITYEEKFYRGEAIVLTVPGSERSYDLTGLKP GTEYKVWIVGVKGGQGSWPLSAIFTT |
| 714 | PRT | Artificial | Luk17T34Q | LPAPKNLVVSRVTEDSARLSWTAPDAAFDSF WIQYEEKFYRGEAIVLTVPGSERSYDLTGLKP GTEYKVWIVGVKGGQGSWPLSAIFTT |
| 715 | PRT | Artificial | Luk17E36Q | LPAPKNLVVSRVTEDSARLSWTAPDAAFDSF WITYQEKFYRGEAIVLTVPGSERSYDLTGLKP GTEYKVWIVGVKGGQGSWPLSAIFTT |
| 716 | PRT | Artificial | Luk17F39E | LPAPKNLVVSRVTEDSARLSWTAPDAAFDSF WITYEEKEYRGEAIVLTVPGSERSYDLTGLKP GTEYKVWIVGVKGGQGSWPLSAIFTT |
| 717 | PRT | Artificial | Luk17Y40K | LPAPKNLVVSRVTEDSARLSWTAPDAAFDSF WITYEEKFKRGEAIVLTVPGSERSYDLTGLKP GTEYKVWIVGVKGGQGSWPLSAIFTT |
| 718 | PRT | Artificial | Luk17R41V | LPAPKNLVVSRVTEDSARLSWTAPDAAFDSF WITYEEKFYVGEAIVLTVPGSERSYDLTGLKP GTEYKVWIVGVKGGQGSWPLSAIFTT |
| 719 | PRT | Artificial | Luk17K68T | LPAPKNLVVSRVTEDSARLSWTAPDAAFDSF WITYEEKFYRGEAIVLTVPGSERSYDLTGLKP GTEYTVWIVGVKGGQGSWPLSAIFTT |
| 720 | PRT | Artificial | Luk17V72Y | LPAPKNLVVSRVTEDSARLSWTAPDAAFDSF WITYEEKFYRGEAIVLTVPGSERSYDLTGLKP GTEYKVWIYGVKGGQGSWPLSAIFTT |
| 721 | PRT | Artificial | Luk17Q78H | LPAPKNLVVSRVTEDSARLSWTAPDAAFDSF WITYEEKFYRGEAIVLTVPGSERSYDLTGLKP GTEYKVWIVGVKGGHGSWPLSAIFTT |
| 722 | PRT | Artificial | Luk17G79R | LPAPKNLVVSRVTEDSARLSWTAPDAAFDSF WITYEEKFYRGEAIVLTVPGSERSYDLTGLKP GTEYKVWIVGVKGGQRSWPLSAIFTT |

TABLE 6-continued

Nucleic Acid and Amino Acid Sequences of the Disclosure

| SEQ ID NO: | Type | Species | Description | Sequence |
|---|---|---|---|---|
| 723 | PRT | Artificial | Luk17W81N | LPAPKNLVVSRVTEDSARLSWTAPDAAFDSF WITYEEKFYRGEAIVLTVPGSERSYDLTGLKP GTEYKVWIVGVKGGQGSNPLSAIFTT |
| 724 | PRT | Artificial | Luk17wtFG | LPAPKNLVVSRVTEDSARLSWTAPDAAFDSF WITYEEKFYRGEAIVLTVPGSERSYDLTGLKP GTEYKVWIVGVKGGHRSNPLSAIFTT |
| 725 | PRT | Artificial | Luk17S38FG | LPAPKNLVVSRVTEDSARLSWTAPDAAFDSF WITYEEKFYRGEAIVLTVPGSERSYDLTGLKP GTEYKVWIVGVELIYHGWLDFVFSNPLSAIFTT |
| 726 | PRT | Artificial | Luk17W32D | LPAPKNLVVSRVTEDSARLSWTAPDAAFDSF DITYEEKFYRGEAIVLTVPGSERSYDLTGLKP GTEYKVWIVGVKGGQGSWPLSAIFTT |
| 727 | PRT | Artificial | Luk17W32T | LPAPKNLVVSRVTEDSARLSWTAPDAAFDSF TITYEEKFYRGEAIVLTVPGSERSYDLTGLKP GTEYKVWIVGVKGGQGSWPLSAIFTT |
| 728 | PRT | Artificial | Luk17W32Q | LPAPKNLVVSRVTEDSARLSWTAPDAAFDSF QITYEEKFYRGEAIVLTVPGSERSYDLTGLKP GTEYKVWIVGVKGGQGSWPLSAIFTT |
| 729 | PRT | Artificial | Luk17W81D | LPAPKNLVVSRVTEDSARLSWTAPDAAFDSF WITYEEKFYRGEAIVLTVPGSERSYDLTGLKP GTEYKVWIVGVKGGQGSDPLSAIFTT |
| 730 | PRT | Artificial | Luk17W81L | LPAPKNLVVSRVTEDSARLSWTAPDAAFDSF WITYEEKFYRGEAIVLTVPGSERSYDLTGLKP GTEYKVWIVGVKGGQGSLPLSAIFTT |
| 731 | PRT | Artificial | Luk17W81T | LPAPKNLVVSRVTEDSARLSWTAPDAAFDSF WITYEEKFYRGEAIVLTVPGSERSYDLTGLKP GTEYKVWIVGVKGGQGSTPLSAIFTT |
| 732 | PRT | Artificial | Luk17W81Q | LPAPKNLVVSRVTEDSARLSWTAPDAAFDSF WITYEEKFYRGEAIVLTVPGSERSYDLTGLKP GTEYKVWIVGVKGGQGSQPLSAIFTT |
| 733 | PRT | Artificial | Luk17W32LW81S | LPAPKNLVVSRVTEDSARLSWTAPDAAFDSF LITYEEKFYRGEAIVLTVPGSERSYDLTGLKP GTEYKVWIVGVKGGQGSSPLSAIFTT |
| 734 | PRT | Artificial | Luk17W32TW81S | LPAPKNLVVSRVTEDSARLSWTAPDAAFDSF TITYEEKFYRGEAIVLTVPGSERSYDLTGLKP GTEYKVWIVGVKGGQGSSPLSAIFTT |
| 735 | PRT | Artificial | Luk17W32SW81S | LPAPKNLVVSRVTEDSARLSWTAPDAAFDSF SITYEEKFYRGEAIVLTVPGSERSYDLTGLKP GTEYKVWIVGVKGGQGSSPLSAIFTT |
| 736 | PRT | Artificial | Luk17W32DW81D | LPAPKNLVVSRVTEDSARLSWTAPDAAFDSF DITYEEKFYRGEAIVLTVPGSERSYDLTGLKP GTEYKVWIVGVKGGQGSDPLSAIFTT |
| 737 | PRT | Artificial | Luk17W32TW81T | LPAPKNLVVSRVTEDSARLSWTAPDAAFDSF TITYEEKFYRGEAIVLTVPGSERSYDLTGLKP GTEYKVWIVGVKGGQGSTPLSAIFTT |
| 738 | PRT | Artificial | Luk17W32QW81Q | LPAPKNLVVSRVTEDSARLSWTAPDAAFDSF QITYEEKFYRGEAIVLTVPGSERSYDLTGLKP GTEYKVWIVGVKGGQGSQPLSAIFTT |
| 739 | PRT | Artificial | Luk26H32A | LPAPKNLVVSRVTEDSARLSWTAPDAAFDSF AIEYAEPWVWGEAIVLTVPGSERSYDLTGLK PGTEYVVFIGGVKGGHNSTPLSAIFTT |
| 740 | PRT | Artificial | Luk26E34A | LPAPKNLVVSRVTEDSARLSWTAPDAAFDSF HIAYAEPWVWGEAIVLTVPGSERSYDLTGLK PGTEYVVFIGGVKGGHNSTPLSAIFTT |

TABLE 6-continued

Nucleic Acid and Amino Acid Sequences of the Disclosure

| SEQ ID NO: | Type | Species | Description | Sequence |
|---|---|---|---|---|
| 741 | PRT | Artificial | Luk26A36S | LPAPKNLVVSRVTEDSARLSWTAPDAAFDSFHIEYSEPWVWGEAIVLTVPGSERSYDLTGLKPGTEYVVFIGGVKGGHNSTPLSAIFTT |
| 742 | PRT | Artificial | Luk26P38A | LPAPKNLVVSRVTEDSARLSWTAPDAAFDSFHIEYAEAWVWGEAIVLTVPGSERSYDLTGLKPGTEYVVFIGGVKGGHNSTPLSAIFTT |
| 743 | PRT | Artificial | Luk26W39A | LPAPKNLVVSRVTEDSARLSWTAPDAAFDSFHIEYAEPAVWGEAIVLTVPGSERSYDLTGLKPGTEYVVFIGGVKGGHNSTPLSAIFTT |
| 744 | PRT | Artificial | Luk26V40A | LPAPKNLVVSRVTEDSARLSWTAPDAAFDSFHIEYAEPWAWGEAIVLTVPGSERSYDLTGLKPGTEYVVFIGGVKGGHNSTPLSAIFTT |
| 745 | PRT | Artificial | Luk26W41A | LPAPKNLVVSRVTEDSARLSWTAPDAAFDSFHIEYAEPWVAGEAIVLTVPGSERSYDLTGLKPGTEYVVFIGGVKGGHNSTPLSAIFTT |
| 746 | PRT | Artificial | Luk26V68A | LPAPKNLVVSRVTEDSARLSWTAPDAAFDSFHIEYAEPWVWGEAIVLTVPGSERSYDLTGLKPGTEYAVFIGGVKGGHNSTPLSAIFTT |
| 747 | PRT | Artificial | Luk26F70A | LPAPKNLVVSRVTEDSARLSWTAPDAAFDSFHIEYAEPWVWGEAIVLTVPGSERSYDLTGLKPGTEYVVAIGGVKGGHNSTPLSAIFTT |
| 748 | PRT | Artificial | Luk26G72A | LPAPKNLVVSRVTEDSARLSWTAPDAAFDSFHIEYAEPWVWGEAIVLTVPGSERSYDLTGLKPGTEYVVFIAGVKGGHNSTPLSAIFTT |
| 749 | PRT | Artificial | Luk26H78A | LPAPKNLVVSRVTEDSARLSWTAPDAAFDSFHIEYAEPWVWGEAIVLTVPGSERSYDLTGLKPGTEYVVFIGGVKGGANSTPLSAIFTT |
| 750 | PRT | Artificial | Luk26N79A | LPAPKNLVVSRVTEDSARLSWTAPDAAFDSFHIEYAEPWVWGEAIVLTVPGSERSYDLTGLKPGTEYVVFIGGVKGGHASTPLSAIFTT |
| 751 | PRT | Artificial | Luk26T81A | LPAPKNLVVSRVTEDSARLSWTAPDAAFDSFHIEYAEPWVWGEAIVLTVPGSERSYDLTGLKPGTEYVVFIGGVKGGHNSAPLSAIFTT |
| 752 | PRT | Artificial | Luk26G42A | LPAPKNLVVSRVTEDSARLSWTAPDAAFDSFHIEYAEPWVWAEAIVLTVPGSERSYDLTGLKPGTEYVVFIGGVKGGHNSTPLSAIFTT |
| 753 | PRT | Artificial | Luk26V46A | LPAPKNLVVSRVTEDSARLSWTAPDAAFDSFHIEYAEPWVWGEAIALTVPGSERSYDLTGLKPGTEYVVFIGGVKGGHNSTPLSAIFTT |
| 754 | PRT | Artificial | Luk26E66A | LPAPKNLVVSRVTEDSARLSWTAPDAAFDSFHIEYAEPWVWGEAIVLTVPGSERSYDLTGLKPGTAYVVFIGGVKGGHNSTPLSAIFTT |
| 755 | PRT | Artificial | Luk26G77A | LPAPKNLVVSRVTEDSARLSWTAPDAAFDSFHIEYAEPWVWGEAIVLTVPGSERSYDLTGLKPGTEYVVFIGGVKGAHNSTPLSAIFTT |
| 756 | PRT | Artificial | Luk26P82A | LPAPKNLVVSRVTEDSARLSWTAPDAAFDSFHIEYAEPWVWGEAIVLTVPGSERSYDLTGLKPGTEYVVFIGGVKGGHNSTALSAIFTT |
| 757 | PRT | Artificial | Luk26S84A | LPAPKNLVVSRVTEDSARLSWTAPDAAFDSFHIEYAEPWVWGEAIVLTVPGSERSYDLTGLKPGTEYVVFIGGVKGGHNSTPLAAIFTT |
| 758 | PRT | Artificial | Luk26I86A | LPAPKNLVVSRVTEDSARLSWTAPDAAFDSFHIEYAEPWVWGEAIVLTVPGSERSYDLTGLKPGTEYVVFIGGVKGGHNSTPLSAAFTT |

TABLE 6-continued

Nucleic Acid and Amino Acid Sequences of the Disclosure

| SEQ ID NO: | Type | Species | Description | Sequence |
|---|---|---|---|---|
| 759 | PRT | Artificial | Luk26H32S | LPAPKNLVVSRVTEDSARLSWTAPDAAFDSF SIEYAEPWVWGEAIVLTVPGSERSYDLTGLK PGTEYVVFIGGVKGGHNSTPLSAIFTT |
| 760 | PRT | Artificial | Luk26E34S | LPAPKNLVVSRVTEDSARLSWTAPDAAFDSF HISYAEPWVWGEAIVLTVPGSERSYDLTGLK PGTEYVVFIGGVKGGHNSTPLSAIFTT |
| 761 | PRT | Artificial | Luk26A36S | LPAPKNLVVSRVTEDSARLSWTAPDAAFDSF HIEYSEPWVWGEAIVLTVPGSERSYDLTGLK PGTEYVVFIGGVKGGHNSTPLSAIFTT |
| 762 | PRT | Artificial | Luk26P38S | LPAPKNLVVSRVTEDSARLSWTAPDAAFDSF HIEYAESWVWGEAIVLTVPGSERSYDLTGLK PGTEYVVFIGGVKGGHNSTPLSAIFTT |
| 763 | PRT | Artificial | Luk26W39S | LPAPKNLVVSRVTEDSARLSWTAPDAAFDSF HIEYAEPSVWGEAIVLTVPGSERSYDLTGLKP GTEYVVFIGGVKGGHNSTPLSAIFTT |
| 764 | PRT | Artificial | Luk26V40S | LPAPKNLVVSRVTEDSARLSWTAPDAAFDSF HIEYAEPWSWGEAIVLTVPGSERSYDLTGLK PGTEYVVFIGGVKGGHNSTPLSAIFTT |
| 765 | PRT | Artificial | Luk26W41S | LPAPKNLVVSRVTEDSARLSWTAPDAAFDSF HIEYAEPWVSGEAIVLTVPGSERSYDLTGLKP GTEYVVFIGGVKGGHNSTPLSAIFTT |
| 766 | PRT | Artificial | Luk26V68S | LPAPKNLVVSRVTEDSARLSWTAPDAAFDSF HIEYAEPWVWGEAIVLTVPGSERSYDLTGLK PGTEYSVFIGGVKGGHNSTPLSAIFTT |
| 767 | PRT | Artificial | Luk26F70S | LPAPKNLVVSRVTEDSARLSWTAPDAAFDSF HIEYAEPWVWGEAIVLTVPGSERSYDLTGLK PGTEYVVSIGGVKGGHNSTPLSAIFTT |
| 768 | PRT | Artificial | Luk26G72S | LPAPKNLVVSRVTEDSARLSWTAPDAAFDSF HIEYAEPWVWGEAIVLTVPGSERSYDLTGLK PGTEYVVFISGVKGGHNSTPLSAIFTT |
| 769 | PRT | Artificial | Luk26H78S | LPAPKNLVVSRVTEDSARLSWTAPDAAFDSF HIEYAEPWVWGEAIVLTVPGSERSYDLTGLK PGTEYVVFIGGVKGGSNSTPLSAIFTT |
| 770 | PRT | Artificial | Luk26N79S | LPAPKNLVVSRVTEDSARLSWTAPDAAFDSF HIEYAEPWVWGEAIVLTVPGSERSYDLTGLK PGTEYVVFIGGVKGGHSSTPLSAIFTT |
| 771 | PRT | Artificial | Luk26T81S | LPAPKNLVVSRVTEDSARLSWTAPDAAFDSF HIEYAEPWVWGEAIVLTVPGSERSYDLTGLK PGTEYVVFIGGVKGGHNSSPLSAIFTT |
| 772 | PRT | Artificial | Luk26G42S | LPAPKNLVVSRVTEDSARLSWTAPDAAFDSF HIEYAEPWVWSEAIVLTVPGSERSYDLTGLK PGTEYVVFIGGVKGGHNSTPLSAIFTT |
| 773 | PRT | Artificial | Luk26A44S | LPAPKNLVVSRVTEDSARLSWTAPDAAFDSF HIEYAEPWVWGESIVLTVPGSERSYDLTGLK PGTEYVVFIGGVKGGHNSTPLSAIFTT |
| 774 | PRT | Artificial | Luk26V46S | LPAPKNLVVSRVTEDSARLSWTAPDAAFDSF HIEYAEPWVWGEAISLTVPGSERSYDLTGLK PGTEYVVFIGGVKGGHNSTPLSAIFTT |
| 775 | PRT | Artificial | Luk26E66S | LPAPKNLVVSRVTEDSARLSWTAPDAAFDSF HIEYAEPWVWGEAIVLTVPGSERSYDLTGLK PGTSYVVFIGGVKGGHNSTPLSAIFTT |
| 776 | PRT | Artificial | Luk26G77S | LPAPKNLVVSRVTEDSARLSWTAPDAAFDSF HIEYAEPWVWGEAIVLTVPGSERSYDLTGLK PGTEYVVFIGGVKGSHNSTPLSAIFTT |

TABLE 6-continued

Nucleic Acid and Amino Acid Sequences of the Disclosure

| SEQ ID NO: | Type | Species | Description | Sequence |
|---|---|---|---|---|
| 777 | PRT | Artificial | Luk26P82S | LPAPKNLVVSRVTEDSARLSWTAPDAAFDSF HIEYAEPWVWGEAIVLTVPGSERSYDLTGLK PGTEYVVFIGGVKGGHNSTSLSAIFTT |
| 778 | PRT | Artificial | Luk26S84S | LPAPKNLVVSRVTEDSARLSWTAPDAAFDSF HIEYAEPWVWGEAIVLTVPGSERSYDLTGLK PGTEYVVFIGGVKGGHNSTPLSAIFTT |
| 779 | PRT | Artificial | Luk26I86S | LPAPKNLVVSRVTEDSARLSWTAPDAAFDSF HIEYAEPWVWGEAIVLTVPGSERSYDLTGLK PGTEYVVFIGGVKGGHNSTPLSASFTT |
| 780 | PRT | Artificial | Luk26H32L | LPAPKNLVVSRVTEDSARLSWTAPDAAFDSF LIEYAEPWVWGEAIVLTVPGSERSYDLTGLK PGTEYVVFIGGVKGGHNSTPLSAIFTT |
| 781 | PRT | Artificial | Luk26E34Q | LPAPKNLVVSRVTEDSARLSWTAPDAAFDSF HIQYAEPWVWGEAIVLTVPGSERSYDLTGLK PGTEYVVFIGGVKGGHNSTPLSAIFTT |
| 782 | PRT | Artificial | Luk26A36Q | LPAPKNLVVSRVTEDSARLSWTAPDAAFDSF HIEYQEPWVWGEAIVLTVPGSERSYDLTGLK PGTEYVVFIGGVKGGHNSTPLSAIFTT |
| 783 | PRT | Artificial | Luk26W39E | LPAPKNLVVSRVTEDSARLSWTAPDAAFDSF HIEYAEPEVWGEAIVLTVPGSERSYDLTGLKP GTEYVVFIGGVKGGHNSTPLSAIFTT |
| 784 | PRT | Artificial | Luk26V40K | LPAPKNLVVSRVTEDSARLSWTAPDAAFDSF HIEYAEPWKWGEAIVLTVPGSERSYDLTGLK PGTEYVVFIGGVKGGHNSTPLSAIFTT |
| 785 | PRT | Artificial | Luk26W41V | LPAPKNLVVSRVTEDSARLSWTAPDAAFDSF HIEYAEPWVVGEAIVLTVPGSERSYDLTGLKP GTEYVVFIGGVKGGHNSTPLSAIFTT |
| 786 | PRT | Artificial | Luk26V68T | LPAPKNLVVSRVTEDSARLSWTAPDAAFDSF HIEYAEPWVWGEAIVLTVPGSERSYDLTGLK PGTEYTVFIGGVKGGHNSTPLSAIFTT |
| 787 | PRT | Artificial | Luk26G72Y | LPAPKNLVVSRVTEDSARLSWTAPDAAFDSF HIEYAEPWVWGEAIVLTVPGSERSYDLTGLK PGTEYVVFIYGVKGGHNSTPLSAIFTT |
| 788 | PRT | Artificial | Luk26N79R | LPAPKNLVVSRVTEDSARLSWTAPDAAFDSF HIEYAEPWVWGEAIVLTVPGSERSYDLTGLK PGTEYVVFIGGVKGGHRSTPLSAIFTT |
| 789 | PRT | Artificial | Luk26T81N | LPAPKNLVVSRVTEDSARLSWTAPDAAFDSF HIEYAEPWVWGEAIVLTVPGSERSYDLTGLK PGTEYVVFIGGVKGGHNSNPLSAIFTT |
| 790 | PRT | Artificial | Luk26wtFG | LPAPKNLVVSRVTEDSARLSWTAPDAAFDSF HIEYAEPWVWGEAIVLTVPGSERSYDLTGLK PGTEYVVFIGGVKGGHRSNPLSAIFTT |
| 791 | PRT | Artificial | Luk26S38FG | LPAPKNLVVSRVTEDSARLSWTAPDAAFDSF HIEYAEPWVWGEAIVLTVPGSERSYDLTGLK PGTEYVVFIGGVELIYHGWLDFVFSNPLSAIF TT |
| 792 | PRT | Artificial | Luk26V68D | LPAPKNLVVSRVTEDSARLSWTAPDAAFDSF HIEYAEPWVWGEAIVLTVPGSERSYDLTGLK PGTEYDVFIGGVKGGHNSTPLSAIFTT |
| 793 | PRT | Artificial | Luk26V68T | LPAPKNLVVSRVTEDSARLSWTAPDAAFDSF HIEYAEPWVWGEAIVLTVPGSERSYDLTGLK PGTEYTVFIGGVKGGHNSTPLSAIFTT |
| 794 | PRT | Artificial | Luk26V68Q | LPAPKNLVVSRVTEDSARLSWTAPDAAFDSF HIEYAEPWVWGEAIVLTVPGSERSYDLTGLK PGTEYQVFIGGVKGGHNSTPLSAIFTT |

TABLE 6-continued

Nucleic Acid and Amino Acid Sequences of the Disclosure

| SEQ ID NO: | Type | Species | Description | Sequence |
|---|---|---|---|---|
| 795 | PRT | Artificial | Luk26W39Q | LPAPKNLVVSRVTEDSARLSWTAPDAAFDSF HIEYAEPQVWGEAIVLTVPGSERSYDLTGLKP GTEYVVFIGGVKGGHNSTPLSAIFTT |
| 796 | PRT | Artificial | Luk26W39T | LPAPKNLVVSRVTEDSARLSWTAPDAAFDSF HIEYAEPTVWGEAIVLTVPGSERSYDLTGLKP GTEYVVFIGGVKGGHNSTPLSAIFTT |
| 797 | PRT | Artificial | Luk26S84D | LPAPKNLVVSRVTEDSARLSWTAPDAAFDSF HIEYAEPWVWGEAIVLTVPGSERSYDLTGLK PGTEYVVFIGGVKGGHNSTPLDAIFTT |
| 798 | PRT | Artificial | Luk26S84T | LPAPKNLVVSRVTEDSARLSWTAPDAAFDSF HIEYAEPWVWGEAIVLTVPGSERSYDLTGLK PGTEYVVFIGGVKGGHNSTPLTAIFTT |
| 799 | PRT | Artificial | Luk26S84Q | LPAPKNLVVSRVTEDSARLSWTAPDAAFDSF HIEYAEPWVWGEAIVLTVPGSERSYDLTGLK PGTEYVVFIGGVKGGHNSTPLQAIFTT |
| 800 | PRT | Artificial | Luk26W41Q | LPAPKNLVVSRVTEDSARLSWTAPDAAFDSF HIEYAEPWVQGEAIVLTVPGSERSYDLTGLKP GTEYVVFIGGVKGGHNSTPLSAIFTT |
| 801 | PRT | Artificial | Luk26W41T | LPAPKNLVVSRVTEDSARLSWTAPDAAFDSF HIEYAEPWVTGEAIVLTVPGSERSYDLTGLKP GTEYVVFIGGVKGGHNSTPLSAIFTT |
| 802 | PRT | Artificial | Luk26V68DS84D | LPAPKNLVVSRVTEDSARLSWTAPDAAFDSF HIEYAEPWVWGEAIVLTVPGSERSYDLTGLK PGTEYDVFIGGVKGGHNSTPLDAIFTT |
| 803 | PRT | Artificial | Luk26V68DS84T | LPAPKNLVVSRVTEDSARLSWTAPDAAFDSF HIEYAEPWVWGEAIVLTVPGSERSYDLTGLK PGTEYDVFIGGVKGGHNSTPLTAIFTT |
| 804 | PRT | Artificial | Luk26V68TS84D | LPAPKNLVVSRVTEDSARLSWTAPDAAFDSF HIEYAEPWVWGEAIVLTVPGSERSYDLTGLK PGTEYTVFIGGVKGGHNSTPLDAIFTT |
| 805 | PRT | Artificial | Luk26V68TS84T | LPAPKNLVVSRVTEDSARLSWTAPDAAFDSF HIEYAEPWVWGEAIVLTVPGSERSYDLTGLK PGTEYTVFIGGVKGGHNSTPLTAIFTT |
| 806 | PRT | Artificial | Luk26V68QS84Q | LPAPKNLVVSRVTEDSARLSWTAPDAAFDSF HIEYAEPWVWGEAIVLTVPGSERSYDLTGLK PGTEYQVFIGGVKGGHNSTPLQAIFTT |
| 807 | PRT | Artificial | Luk26V68QS84D | LPAPKNLVVSRVTEDSARLSWTAPDAAFDSF HIEYAEPWVWGEAIVLTVPGSERSYDLTGLK PGTEYQVFIGGVKGGHNSTPLDAIFTT |
| 808 | PRT | Artificial | Luk26V68QS84T | LPAPKNLVVSRVTEDSARLSWTAPDAAFDSF HIEYAEPWVWGEAIVLTVPGSERSYDLTGLK PGTEYQVFIGGVKGGHNSTPLTAIFTT |
| 809 | PRT | Artificial | Luk26V68DS84Q | LPAPKNLVVSRVTEDSARLSWTAPDAAFDSF HIEYAEPWVWGEAIVLTVPGSERSYDLTGLK PGTEYDVFIGGVKGGHNSTPLQAIFTT |
| 810 | PRT | Artificial | Luk26V68TS84Q | LPAPKNLVVSRVTEDSARLSWTAPDAAFDSF HIEYAEPWVWGEAIVLTVPGSERSYDLTGLK PGTEYTVFIGGVKGGHNSTPLQAIFTT |
| 811 | PRT | Artificial | Luk26W39QW41Q | LPAPKNLVVSRVTEDSARLSWTAPDAAFDSF HIEYAEPQVQGEAIVLTVPGSERSYDLTGLKP GTEYVVFIGGVKGGHNSTPLSAIFTT |
| 812 | PRT | Artificial | Luk26W39QW41T | LPAPKNLVVSRVTEDSARLSWTAPDAAFDSF HIEYAEPQVTGEAIVLTVPGSERSYDLTGLKP GTEYVVFIGGVKGGHNSTPLSAIFTT |

TABLE 6-continued

Nucleic Acid and Amino Acid Sequences of the Disclosure

| SEQ ID NO: | Type | Species | Description | Sequence |
|---|---|---|---|---|
| 813 | PRT | Artificial | Luk26W39TW41Q | LPAPKNLVVSRVTEDSARLSWTAPDAAFDSF HIEYAEPTVQGEAIVLTVPGSERSYDLTGLKP GTEYVVFIGGVKGGHNSTPLSAIFTT |
| 814 | PRT | Artificial | Luk26W39TW41T | LPAPKNLVVSRVTEDSARLSWTAPDAAFDSF HIEYAEPTVTGEAIVLTVPGSERSYDLTGLKP GTEYVVFIGGVKGGHNSTPLSAIFTT |
| 815 | PRT | Artificial | Luk27P32A | LPAPKNLVVSRVTEDSARLSWTAPDAAFDSF AIVYQEWQFYGEAIVLTVPGSERSYDLTGLK PGTEYLVDIYGVKGGSWSYPLSAIFTT |
| 816 | PRT | Artificial | Luk27V34A | LPAPKNLVVSRVTEDSARLSWTAPDAAFDSF PIAYQEWQFYGEAIVLTVPGSERSYDLTGLKP GTEYLVDIYGVKGGSWSYPLSAIFTT |
| 817 | PRT | Artificial | Luk27Q36A | LPAPKNLVVSRVTEDSARLSWTAPDAAFDSF PIVYAEWQFYGEAIVLTVPGSERSYDLTGLKP GTEYLVDIYGVKGGSWSYPLSAIFTT |
| 818 | PRT | Artificial | Luk27W38A | LPAPKNLVVSRVTEDSARLSWTAPDAAFDSF PIVYQEAQFYGEAIVLTVPGSERSYDLTGLKP GTEYLVDIYGVKGGSWSYPLSAIFTT |
| 819 | PRT | Artificial | Luk27Q39A | LPAPKNLVVSRVTEDSARLSWTAPDAAFDSF PIVYQEWAFYGEAIVLTVPGSERSYDLTGLKP GTEYLVDIYGVKGGSWSYPLSAIFTT |
| 820 | PRT | Artificial | Luk27F40A | LPAPKNLVVSRVTEDSARLSWTAPDAAFDSF PIVYQEWQAYGEAIVLTVPGSERSYDLTGLK PGTEYLVDIYGVKGGSWSYPLSAIFTT |
| 821 | PRT | Artificial | Luk27Y41A | LPAPKNLVVSRVTEDSARLSWTAPDAAFDSF PIVYQEWQFAGEAIVLTVPGSERSYDLTGLKP GTEYLVDIYGVKGGSWSYPLSAIFTT |
| 822 | PRT | Artificial | Luk27L68A | LPAPKNLVVSRVTEDSARLSWTAPDAAFDSF PIVYQEWQFYGEAIVLTVPGSERSYDLTGLKP GTEYAVDIYGVKGGSWSYPLSAIFTT |
| 823 | PRT | Artificial | Luk27D70A | LPAPKNLVVSRVTEDSARLSWTAPDAAFDSF PIVYQEWQFYGEAIVLTVPGSERSYDLTGLKP GTEYLVAIYGVKGGSWSYPLSAIFTT |
| 824 | PRT | Artificial | Luk27Y72A | LPAPKNLVVSRVTEDSARLSWTAPDAAFDSF PIVYQEWQFYGEAIVLTVPGSERSYDLTGLKP GTEYLVDIAGVKGGSWSYPLSAIFTT |
| 825 | PRT | Artificial | Luk27S78A | LPAPKNLVVSRVTEDSARLSWTAPDAAFDSF PIVYQEWQFYGEAIVLTVPGSERSYDLTGLKP GTEYLVDIYGVKGGAWSYPLSAIFTT |
| 826 | PRT | Artificial | Luk27W79A | LPAPKNLVVSRVTEDSARLSWTAPDAAFDSF PIVYQEWQFYGEAIVLTVPGSERSYDLTGLKP GTEYLVDIYGVKGGSASYPLSAIFTT |
| 827 | PRT | Artificial | Luk27Y81A | LPAPKNLVVSRVTEDSARLSWTAPDAAFDSF PIVYQEWQFYGEAIVLTVPGSERSYDLTGLKP GTEYLVDIYGVKGGSWSAPLSAIFTT |
| 828 | PRT | Artificial | Luk38E75A | LPAPKNLVVSRVTEDSARLSWTAPDAAFDSF LIQYQESEKVGEAIVLTVPGSERSYDLTGLKP GTEYTVSIYGVALIYHGWLDFVFSNPLSAIFTT |
| 829 | PRT | Artificial | Luk38L76A | LPAPKNLVVSRVTEDSARLSWTAPDAAFDSF LIQYQESEKVGEAIVLTVPGSERSYDLTGLKP GTEYTVSIYGVEAIYHGWLDFVFSNPLSAIFTT |
| 830 | PRT | Artificial | Luk38I77A | LPAPKNLVVSRVTEDSARLSWTAPDAAFDSF LIQYQESEKVGEAIVLTVPGSERSYDLTGLKP GTEYTVSIYGVELAYHGWLDFVFSNPLSAIFTT |

TABLE 6-continued

Nucleic Acid and Amino Acid Sequences of the Disclosure

| SEQ ID NO: | Type | Species | Description | Sequence |
|---|---|---|---|---|
| 831 | PRT | Artificial | Luk38Y78A | LPAPKNLVVSRVTEDSARLSWTAPDAAFDSF LIQYQESEKVGEAIVLTVPGSERSYDLTGLKP GTEYTVSIYGVELIAHGWLDFVFSNPLSAIFTT |
| 832 | PRT | Artificial | Luk38H79A | LPAPKNLVVSRVTEDSARLSWTAPDAAFDSF LIQYQESEKVGEAIVLTVPGSERSYDLTGLKP GTEYTVSIYGVELIYAGWLDFVFSNPLSAIFTT |
| 833 | PRT | Artificial | Luk38G80A | LPAPKNLVVSRVTEDSARLSWTAPDAAFDSF LIQYQESEKVGEAIVLTVPGSERSYDLTGLKP GTEYTVSIYGVELIYHAWLDFVFSNPLSAIFTT |
| 834 | PRT | Artificial | Luk38W81A | LPAPKNLVVSRVTEDSARLSWTAPDAAFDSF LIQYQESEKVGEAIVLTVPGSERSYDLTGLKP GTEYTVSIYGVELIYHGALDFVFSNPLSAIFTT |
| 835 | PRT | Artificial | Luk38L82A | LPAPKNLVVSRVTEDSARLSWTAPDAAFDSF LIQYQESEKVGEAIVLTVPGSERSYDLTGLKP GTEYTVSIYGVELIYHGWADFVFSNPLSAIFTT |
| 836 | PRT | Artificial | Luk38D83A | LPAPKNLVVSRVTEDSARLSWTAPDAAFDSF LIQYQESEKVGEAIVLTVPGSERSYDLTGLKP GTEYTVSIYGVELIYHGWLAFVFSNPLSAIFTT |
| 837 | PRT | Artificial | Luk38F84A | LPAPKNLVVSRVTEDSARLSWTAPDAAFDSF LIQYQESEKVGEAIVLTVPGSERSYDLTGLKP GTEYTVSIYGVELIYHGWLDAVFSNPLSAIFTT |
| 838 | PRT | Artificial | Luk38V85A | LPAPKNLVVSRVTEDSARLSWTAPDAAFDSF LIQYQESEKVGEAIVLTVPGSERSYDLTGLKP GTEYTVSIYGVELIYHGWLDFAFSNPLSAIFTT |
| 839 | PRT | Artificial | Luk38F86A | LPAPKNLVVSRVTEDSARLSWTAPDAAFDSF LIQYQESEKVGEAIVLTVPGSERSYDLTGLKP GTEYTVSIYGVELIYHGWLDFVASNPLSAIFTT |
| 840 | PRT | Human | CR-5133LC | EIVLTQSPATLSLSPGERATLSCRASQSVSGYL GWYQQKPGQAPRLLIYGASSRATGIPDRFSG SGSGTDFTLTISRLEPEDFAVYYCQQYGSSPL TFGGGTKLEIKRTVAAPSVFIFPPSDEQLKSGT ASVVCLLNNFYPREAKVQWKVDNALQSGNS QESVTEQDSKDSTYSLSSTLTLSKADYEKHK VYACEVTHQGLSSPVTKSFNRGEC |
| 841 | PRT | Human | ProteinA3LC | EIVLTQSPATLSLSPGERATLSCRASQSVADD LAWYQQKPGQAPRLLIYFASNRATGIPARFS GSGSGTDFTLTISSLEPEDFAVYYCQQRYGW PWTFGQGTKVEIKRTVAAPSVFIFPPSDEQLK SGTASVVCLLNNFYPREAKVQWKVDNALQS GNSQESVTEQDSKDSTYSLSSTLTLSKADYEK HKVYACEVTHQGLSSPVTKSFNRGEC |
| 842 | PRT | Human | ProteinA9LC | EIVLTQSPATLSLSPGERATLSCRASQSVSNAL AWYQQKPGQAPRLLIYGAGNRATGIPARFSG SGSGTDFTLTISSLEPEDFAVYYCQQRHNWPR TFGQGTKVEIKRTVAAPSVFIFPPSDEQLKSG TASVVCLLNNFYPREAKVQWKVDNALQSGN SQESVTEQDSKDSTYSLSSTLTLSKADYEKHK VYACEVTHQGLSSPVTKSFNRGEC |
| 843 | PRT | Human | RSVLC | DIVMTQSPDSLAVSLGERATINCRASQSVDY NGISYMHWYQQKPGQPPKLLIYAASNPESGV PDRFSGSGSGTDFTLTISSLQAEDVAVYYCQQ IIEDPWTFGQGTKVEIKRTVAAPSVFIFPPSDE QLKSGTASVVCLLNNFYPREAKVQWKVDNA LQSGNSQESVTEQDSKDSTYSLSSTLTLSKAD YEKHKVYACEVTHQGLSSPVTKSFNRGEC |
| 844 | PRT | Human | CSD7LC | EIVMTQSPATLSVSPGERATLSCRASQYVSDN LAWYQQKPGQAPRLLIYGASTRATGVPARFS GSGSGTEFTLTISSLQSEDFAVYYCQQYNNW RPVTFGQGTRLEIKRTVAAPSVFIFPPSDEQLK |

TABLE 6-continued

Nucleic Acid and Amino Acid Sequences of the Disclosure

| SEQ ID NO: | Type | Species | Description | Sequence |
|---|---|---|---|---|
| | | | | SGTASVVCLLNNFYPREAKVQWKVDNALQS GNSQESVTEQDSKDSTYSLSSTLTLSKADYEK HKVYACEVTHQGLSSPVTKSFNRGEC |
| 845 | PRT | Human | CR-6526LC | QSALTQPPSASGSPGQSVTISCTGTSSDVGGY NYVSWYQQRPGKAPKLMIYDVSNRPSGVSD RFSGSKSGNTASLTISGLQAEDEADYYCSSYT TGSTLVVFGGGTKLTVLGQPKAAPSVTLFPPS SEELQANKATLVCLISDFYPGAVTVAWKADS SPVKAGVETTTPSKQSNNKYAASSYLSLTPE QWKSHRSYSCQVTHEGSTVEKTVAPTECS |
| 846 | PRT | Human | PagibaximabLC | DIVLSQSPAILSASPGEKVTMTCRASSSVNYM HWYQQKPGSSPKPWISATSNLASGVPARFSG SGSGTSYSLTISRVEAEDAATYYCQQWSSNPP TFGGGTMLEIKRTVAAPSVFIFPPSDEQLKSG TASVVCLLNNFYPREAKVQWKVDNALQSGN SQESVTEQDSKDSTYSLSSTLTLSKADYEKHK VYACEVTHQGLSSPVTKSFNRGEC |
| 847 | PRT | Human | CR-6171LC | QSVLTQPPSLSVSPGQTASISCSGDKLGDKYV SWYQQRPGQSPVLVIYHDTKRPSGIPERFSGT NSGNTATLTISGTQILDEADYYCQVWDRSTV VFGGGTQLTVLGQPKAAPSVTLFPPSSEELQA NKATLVCLISDFYPGAVTVAWKADSSPVKA GVETTTPSKQSNNKYAASSYLSLTPEQWKSH RSYSCQVTHEGSTVEKTVAPTECS |
| 848 | PRT | Human | CR-5133HC66 | EVQLVETGGGLVKPGGSLRLSCSASRFSFRD YYMTWIRQAPGKGPEWVSHISGSGSTIYYAD SVRGRFTISRDNAKSSLYLQMDSLQADDTAV YYCARGGRATSYYWVHWGPGTLVTVSSAST KGPSVFPLAPSSKSTSGGTAALGCLVKDYFPE PVTVSWNSGALTSGVHTFPAVLQSSGLYSLS SVVTVPSSSLGTQTYICNVNHKPSNTKVDKK VEPKSCDKTHTCPPCPAPPVAGPDVFLFPPKP KDTLMISRTPEVTCVVVDVSHEDPEVKFNWY VDGVEVHNAKTKPREEQYNSTYRVVSVLTV LHQDWLNGKEYKCKVSNAALPAPIAKTISKA KGQPREPQVYTLPPSRDELTKNQVSLTCLVK GFYPSDIAVEWESNGQPENNYKTTPPVLDSD GSFFLYSKLTVDKSRWQQGNVFSCSVMHEA LHNRFTQKSLSLSPGKGGGGSGGGGSGGGGS GGGGSMLPAPKNLVVSRVTEDSARLSWTAP DAAFDSFHIEYAEPWVWGEAIVLTVPGSERS YDLTGLKPGTEYVVFIGGVKGGHNSTPLSAIF TT |
| 849 | PRT | Human | CR-5133HC67 | EVQLVETGGGLVKPGGSLRLSCSASRFSFRD YYMTWIRQAPGKGPEWVSHISGSGSTIYYAD SVRGRFTISRDNAKSSLYLQMDSLQADDTAV YYCARGGRATSYYWVHWGPGTLVTVSSAST KGPSVFPLAPSSKSTSGGTAALGCLVKDYFPE PVTVSWNSGALTSGVHTFPAVLQSSGLYSLS SVVTVPSSSLGTQTYICNVNHKPSNTKVDKK VEPKSCDKTHTCPPCPAPPVAGPDVFLFPPKP KDTLMISRTPEVTCVVVDVSHEDPEVKFNWY VDGVEVHNAKTKPREEQYNSTYRVVSVLTV LHQDWLNGKEYKCKVSNAALPAPIAKTISKA KGQPREPQVYTLPPSRDELTKNQVSLTCLVK GFYPSDIAVEWESNGQPENNYKTTPPVLDSD GSFFLYSKLTVDKSRWQQGNVFSCSVMHEA LHNRFTQKSLSLSPGKGGGGSGGGGSGGGGS GGGGSLPAPKNLVVSRVTEDSARLSWTAPDA AFDSFHIEYAEPWVWGEAIVLTVPGSERSYD LTGLKPGTEYVVFIGGVKGGHNSTPLSAIFTT |
| 850 | PRT | Human | CR-5133HC68 | EVQLVETGGGLVKPGGSLRLSCSASRFSFRD YYMTWIRQAPGKGPEWVSHISGSGSTIYYAD SVRGRFTISRDNAKSSLYLQMDSLQADDTAV YYCARGGRATSYYWVHWGPGTLVTVSSAST KGPSVFPLAPSSKSTSGGTAALGCLVKDYFPE PVTVSWNSGALTSGVHTFPAVLQSSGLYSLS SVVTVPSSSLGTQTYICNVNHKPSNTKVDKK VEPKSCDKTHTCPPCPAPPVAGPDVFLFPPKP |

TABLE 6-continued

Nucleic Acid and Amino Acid Sequences of the Disclosure

| SEQ ID NO: | Type | Species | Description | Sequence |
|---|---|---|---|---|
| | | | | KDTLMISRTPEVTCVVVDVSHEDPEVKFNWY VDGVEVHNAKTKPREEQYNSTYRVVSVLTV LHQDWLNGKEYKCKVSNAALPAPIAKTISKA KGQPREPQVYTLPPSRDELTKNQVSLTCLVK GFYPSDIAVEWESNGQPENNYKTTPPVLDSD GSFFLYSKLTVDKSRWQQGNVFSCSVMHEA LHNRFTQKSLSLSPGKGGGGSGGGGSGGGGS GGGGSMLPAPKNLVVSRVTEDSARLSWTAP DAAFDSFPIVYQEWQFYGEAIVLTVPGSERSY DLTGLKPGTEYLVDIYGVKGGSWSYPLSAIFTT |
| 851 | PRT | Human | CR-5133HC69 | EVQLVETGGGLVKPGGSLRLSCSASRFSFRD YYMTWIRQAPGKGPEWVSHISGSGSTIYYAD SVRGRFTISRDNAKSSLYLQMDSLQADDTAV YYCARGGRATSYYWVHWGPGTLVTVSSAST KGPSVFPLAPSSKSTSGGTAALGCLVKDYFPE PVTVSWNSGALTSGVHTFPAVLQSSGLYSLS SVVTVPSSSLGTQTYICNVNHKPSNTKVDKK VEPKSCDKTHTCPPCPAPPVAGPDVLFPPKP KDTLMISRTPEVTCVVVDVSHEDPEVKFNWY VDGVEVHNAKTKPREEQYNSTYRVVSVLTV LHQDWLNGKEYKCKVSNAALPAPIAKTISKA KGQPREPQVYTLPPSRDELTKNQVSLTCLVK GFYPSDIAVEWESNGQPENNYKTTPPVLDSD GSFFLYSKLTVDKSRWQQGNVFSCSVMHEA LHNRFTQKSLSLSPGKGGGGSGGGGSGGGGS GGGGSLPAPKNLVVSRVTEDSARLSWTAPDA AFDSFPIVYQEWQFYGEAIVLTVPGSERSYDL TGLKPGTEYLVDIYGVKGGSWSYPLSAIFTT |
| 852 | PRT | Human | CR-5133HC70 | EVQLVETGGGLVKPGGSLRLSCSASRFSFRD YYMTWIRQAPGKGPEWVSHISGSGSTIYYAD SVRGRFTISRDNAKSSLYLQMDSLQADDTAV YYCARGGRATSYYWVHWGPGTLVTVSSAST KGPSVFPLAPSSKSTSGGTAALGCLVKDYFPE PVTVSWNSGALTSGVHTFPAVLQSSGLYSLS SVVTVPSSSLGTQTYICNVNHKPSNTKVDKK VEPKSCDKTHTCPPCPAPPVAGPDVLFPPKP KDTLMISRTPEVTCVVVDVSHEDPEVKFNWY VDGVEVHNAKTKPREEQYNSTYRVVSVLTV LHQDWLNGKEYKCKVSNAALPAPIAKTISKA KGQPREPQVYTLPPSRDELTKNQVSLTCLVK GFYPSDIAVEWESNGQPENNYKTTPPVLDSD GSFFLYSKLTVDKSRWQQGNVFSCSVMHEA LHNRFTQKSLSLSPGKGGGGSGGGGSGGGGS GGGGSMLPAPKNLVVSRVTEDSARLSWTAP DAAFDSFWITYEEKFYRGEAIVLTVPGSERSY DLTGLKPGTEYKVWIVGVKGGQGSWPLSAIF TTGGGGSGGGGSGGGGSGGGGSMLPAPKNL VVSRVTEDSARLSWTAPDAAFDSFHIEYAEP WVWGEAIVLTVPGSERSYDLTGLKPGTEYV VFIGGVKGGHNSTPLSAIFTT |
| 853 | PRT | Human | CR-5133HC71 | EVQLVETGGGLVKPGGSLRLSCSASRFSFRD YYMTWIRQAPGKGPEWVSHISGSGSTIYYAD SVRGRFTISRDNAKSSLYLQMDSLQADDTAV YYCARGGRATSYYWVHWGPGTLVTVSSAST KGPSVFPLAPSSKSTSGGTAALGCLVKDYFPE PVTVSWNSGALTSGVHTFPAVLQSSGLYSLS SVVTVPSSSLGTQTYICNVNHKPSNTKVDKK VEPKSCDKTHTCPPCPAPPVAGPDVLFPPKP KDTLMISRTPEVTCVVVDVSHEDPEVKFNWY VDGVEVHNAKTKPREEQYNSTYRVVSVLTV LHQDWLNGKEYKCKVSNAALPAPIAKTISKA KGQPREPQVYTLPPSRDELTKNQVSLTCLVK GFYPSDIAVEWESNGQPENNYKTTPPVLDSD GSFFLYSKLTVDKSRWQQGNVFSCSVMHEA LHNRFTQKSLSLSPGKGGGGSGGGGSGGGGS GGGGSMLPAPKNLVVSRVTEDSARLSWTAP DAAFDSFWITYEEKFYRGEAIVLTVPGSERSY DLTGLKPGTEYKVWIVGVKGGQGSWPLSAIF TTGGGGSGGGGSGGGGSGGGGSLPAPKNLV VSRVTEDSARLSWTAPDAAFDSFHIEYAEPW VWGEAIVLTVPGSERSYDLTGLKPGTEYVVFI GGVKGGHNSTPLSAIFTT |

TABLE 6-continued

Nucleic Acid and Amino Acid Sequences of the Disclosure

| SEQ ID NO: | Type | Species | Description | Sequence |
|---|---|---|---|---|
| 854 | PRT | Human | CR-5133HC72 | EVQLVETGGGLVKPGGSLRLSCSASRFSFRD YYMTWIRQAPGKGPEWVSHISGSGSTIYYAD SVRGRFTISRDNAKSSLYLQMDSLQADDTAV YYCARGGRATSYYWVHWGPGTLVTVSSAST KGPSVFPLAPSSKSTSGGTAALGCLVKDYFPE PVTVSWNSGALTSGVHTFPAVLQSSGLYSLS SVVTVPSSSLGTQTYICNVNHKPSNTKVDKK VEPKSCDKTHTCPPCPAPPVAGPDVFLFPPKP KDTLMISRTPEVTCVVVDVSHEDPEVKFNWY VDGVEVHNAKTKPREEQYNSTYRVVSVLTV LHQDWLNGKEYKCKVSNAALPAPIAKTISKA KGQPREPQVYTLPPSRDELTKNQVSLTCLVK GFYPSDIAVEWESNGQPENNYKTTPPVLDSD GSFFLYSKLTVDKSRWQQGNVFSCSVMHEA LHNRFTQKSLSLSPGKGGGGSGGGGSGGGGS GGGGSMLPAPKNLVVSRVTEDSARLSWTAP DAAFDSFWITYEEKFYRGEAIVLTVPGSERSY DLTGLKPGTEYKVWIVGVKGGQGSWPLSAIF TTGGGGSGGGGSGGGGSGGGGSMLPAPKNL VVSRVTEDSARLSWTAPDAAFDSFPIVYQEW QFYGEAIVLTVPGSERSYDLTGLKPGTEYLV DIYGVKGGSWSYPLSAIFTT |
| 855 | PRT | Human | CR-5133HC73 | EVQLVETGGGLVKPGGSLRLSCSASRFSFRD YYMTWIRQAPGKGPEWVSHISGSGSTIYYAD SVRGRFTISRDNAKSSLYLQMDSLQADDTAV YYCARGGRATSYYWVHWGPGTLVTVSSAST KGPSVFPLAPSSKSTSGGTAALGCLVKDYFPE PVTVSWNSGALTSGVHTFPAVLQSSGLYSLS SVVTVPSSSLGTQTYICNVNHKPSNTKVDKK VEPKSCDKTHTCPPCPAPPVAGPDVFLFPPKP KDTLMISRTPEVTCVVVDVSHEDPEVKFNWY VDGVEVHNAKTKPREEQYNSTYRVVSVLTV LHQDWLNGKEYKCKVSNAALPAPIAKTISKA KGQPREPQVYTLPPSRDELTKNQVSLTCLVK GFYPSDIAVEWESNGQPENNYKTTPPVLDSD GSFFLYSKLTVDKSRWQQGNVFSCSVMHEA LHNRFTQKSLSLSPGKGGGGSGGGGSGGGGS GGGGSMLPAPKNLVVSRVTEDSARLSWTAP DAAFDSFWITYEEKFYRGEAIVLTVPGSERSY DLTGLKPGTEYKVWIVGVKGGQGSWPLSAIF TTGGGGSGGGGSGGGGSGGGGSLPAPKNLV VSRVTEDSARLSWTAPDAAFDSFPIVYQEWQ FYGEAIVLTVPGSERSYDLTGLKPGTEYLVDI YGVKGGSWSYPLSAIFTT |
| 856 | PRT | Human | CR-5133HC74 | EVQLVETGGGLVKPGGSLRLSCSASRFSFRD YYMTWIRQAPGKGPEWVSHISGSGSTIYYAD SVRGRFTISRDNAKSSLYLQMDSLQADDTAV YYCARGGRATSYYWVHWGPGTLVTVSSAST KGPSVFPLAPSSKSTSGGTAALGCLVKDYFPE PVTVSWNSGALTSGVHTFPAVLQSSGLYSLS SVVTVPSSSLGTQTYICNVNHKPSNTKVDKK VEPKSCDKTHTCPPCPAPPVAGPDVFLFPPKP KDTLMISRTPEVTCVVVDVSHEDPEVKFNWY VDGVEVHNAKTKPREEQYNSTYRVVSVLTV LHQDWLNGKEYKCKVSNAALPAPIAKTISKA KGQPREPQVYTLPPSRDELTKNQVSLTCLVK GFYPSDIAVEWESNGQPENNYKTTPPVLDSD GSFFLYSKLTVDKSRWQQGNVFSCSVMHEA LHNRFTQKSLSLSPGKGGGGSGGGGSGGGGS GGGGSMLPAPKNLVVSRVTEDSARLSWTAP DAAFDSFHIEYAEPWVWGEAIVLTVPGSERS YDLTGLKPGTEYVVFIGGVKGGHNSTPLSAIF TTGGGGSGGGGSGGGGSGGGGSMLPAPKNL VVSRVTEDSARLSWTAPDAAFDSFWITYEEK FYRGEAIVLTVPGSERSYDLTGLKPGTEYKV WIVGVKGGQGSWPLSAIFTT |
| 857 | PRT | Human | CR-5133HC75 | EVQLVETGGGLVKPGGSLRLSCSASRFSFRD YYMTWIRQAPGKGPEWVSHISGSGSTIYYAD SVRGRFTISRDNAKSSLYLQMDSLQADDTAV YYCARGGRATSYYWVHWGPGTLVTVSSAST KGPSVFPLAPSSKSTSGGTAALGCLVKDYFPE |

US 10,781,246 B2
TABLE 6-continued

Nucleic Acid and Amino Acid Sequences of the Disclosure

| SEQ ID NO: | Type | Species | Description | Sequence |
|---|---|---|---|---|
| | | | | PVTVSWNSGALTSGVHTFPAVLQSSGLYSLS SVVTVPSSSLGTQTYICNVNHKPSNTKVDKK VEPKSCDKTHTCPPCPAPPVAGPDVFLPPKP KDTLMISRTPEVTCVVVDVSHEDPEVKFNWY VDGVEVHNAKTKPREEQYNSTYRVVSVLTV LHQDWLNGKEYKCKVSNAALPAPIAKTISKA KGQPREPQVYTLPPSRDELTKNQVSLTCLVK GFYPSDIAVEWESNGQPENNYKTTPPVLDSD GSFFLYSKLTVDKSRWQQGNVFSCSVMHEA LHNRFTQKSLSLSPGKGGGGSGGGGSGGGGS GGGGSLPAPKNLVVSRVTEDSARLSWTAPDA AFDSFHIEYAEPWVWGEAIVLTVPGSERSYD LTGLKPGTEYVVFIGGVKGGHNSTPLSAIFTT GGGGSGGGGSGGGGSGGGGSMLPAPKNLVV SRVTEDSARLSWTAPDAAFDSFWITYEEKFY RGEAIVLTVPGSERSYDLTGLKPGTEYKVWI VGVKGGQGSWPLSAIFTT |
| 858 | PRT | Human | CR-5133HC76 | EVQLVETGGGLVKPGGSLRLSCSASRFSFRD YYMTWIRQAPGKGPEWVSHISGSGSTIYYAD SVRGRFTISRDNAKSSLYLQMDSLQADDTAV YYCARGGRATSYYWVHWGPGTLVTVSSAST KGPSVFPLAPSSKSTSGGTAALGCLVKDYFPE PVTVSWNSGALTSGVHTFPAVLQSSGLYSLS SVVTVPSSSLGTQTYICNVNHKPSNTKVDKK VEPKSCDKTHTCPPCPAPPVAGPDVFLPPKP KDTLMISRTPEVTCVVVDVSHEDPEVKFNWY VDGVEVHNAKTKPREEQYNSTYRVVSVLTV LHQDWLNGKEYKCKVSNAALPAPIAKTISKA KGQPREPQVYTLPPSRDELTKNQVSLTCLVK GFYPSDIAVEWESNGQPENNYKTTPPVLDSD GSFFLYSKLTVDKSRWQQGNVFSCSVMHEA LHNRFTQKSLSLSPGKGGGGSGGGGSGGGGS GGGGSMLPAPKNLVVSRVTEDSARLSWTAP DAAFDSFPIVYQEWQFYGEAIVLTVPGSERSY DLTGLKPGTEYLVDIYGVKGGSWSYPLSAIFT TGGGGSGGGGSGGGGSGGGGSMLPAPKNLV VSRVTEDSARLSWTAPDAAFDSFWITYEEKF YRGEAIVLTVPGSERSYDLTGLKPGTEYKVW IVGVKGGQGSWPLSAIFTT |
| 859 | PRT | Human | CR-5133HC77 | EVQLVETGGGLVKPGGSLRLSCSASRFSFRD YYMTWIRQAPGKGPEWVSHISGSGSTIYYAD SVRGRFTISRDNAKSSLYLQMDSLQADDTAV YYCARGGRATSYYWVHWGPGTLVTVSSAST KGPSVFPLAPSSKSTSGGTAALGCLVKDYFPE PVTVSWNSGALTSGVHTFPAVLQSSGLYSLS SVVTVPSSSLGTQTYICNVNHKPSNTKVDKK VEPKSCDKTHTCPPCPAPPVAGPDVFLPPKP KDTLMISRTPEVTCVVVDVSHEDPEVKFNWY VDGVEVHNAKTKPREEQYNSTYRVVSVLTV LHQDWLNGKEYKCKVSNAALPAPIAKTISKA KGQPREPQVYTLPPSRDELTKNQVSLTCLVK GFYPSDIAVEWESNGQPENNYKTTPPVLDSD GSFFLYSKLTVDKSRWQQGNVFSCSVMHEA LHNRFTQKSLSLSPGKGGGGSGGGGSGGGGS GGGGSLPAPKNLVVSRVTEDSARLSWTAPDA AFDSFPIVYQEWQFYGEAIVLTVPGSERSYDL TGLKPGTEYLVDIYGVKGGSWSYPLSAIFTTG GGGSGGGGSGGGGSGGGGSMLPAPKNLVVS RVTEDSARLSWTAPDAAFDSFWITYEEKFYR GEAIVLTVPGSERSYDLTGLKPGTEYKVWIV GVKGGQGSWPLSAIFTT |
| 860 | PRT | Human | ProteinA3HC78 | QVQLVQSGAEVKKPGSSVKVSCKASGGTFSS YAISWVRQAPGQGLEWMGWISAINGNTNYA QKFQGRVTITADESTSTAYMELSSLRSEDTAV YYCARIWNFLLDYWGQGTLVTVSSASTKGPS VFPLAPSSKSTSGGTAALGCLVKDYFPEPVTV SWNSGALTSGVHTFPAVLQSSGLYSLSSVVT VPSSSLGTQTYICNVNHKPSNTKVDKKVEPK SCDKTHTCPPCPAPPVAGPDVFLPPKPKDTL MISRTPEVTCVVVDVSHEDPEVKFNWYVDG VEVHNAKTKPREEQYNSTYRVVSVLTVLHQ DWLNGKEYKCKVSNAALPAPIAKTISKAKGQ |

TABLE 6-continued

Nucleic Acid and Amino Acid Sequences of the Disclosure

| SEQ ID NO: | Type | Species | Description | Sequence |
|---|---|---|---|---|
| | | | | PREPQVYTLPPSRDELTKNQVSLTCLVKGFYP SDIAVEWESNGQPENNYKTTPPVLDSDGSFFL YSKLTVDKSRWQQGNVFSCSVMHEALHNRF TQKSLSLSPGKGGGGSGGGGSGGGGSGGGG SMLPAPKNLVVSRVTEDSARLSWTAPDAAFD SFHIEYAEPWVWGEAIVLTVPGSERSYDLTG LKPGTEYVVFIGGVKGGHNSTPLSAIFTT |
| 861 | PRT | Human | ProteinA3HC79 | QVQLVQSGAEVKKPGSSVKVSCKASGGTFSS YAISWVRQAPGQGLEWMGWISAINGNTNYA QKFQGRVTITADESTSTAYMELSSLRSEDTAV YYCARIWNFLLDYWGQGTLVTVSSASTKGPS VFPLAPSSKSTSGGTAALGCLVKDYFPEPVTV SWNSGALTSGVHTFPAVLQSSGLYSLSSVVT VPSSSLGTQTYICNVNHKPSNTKVDKKVEPK SCDKTHTCPPCPAPPVAGPDVFLFPPKPKDTL MISRTPEVTCVVVDVSHEDPEVKFNWYVDG VEVHNAKTKPREEQYNSTYRVVSVLTVLHQ DWLNGKEYKCKVSNAALPAPIAKTISKAKGQ PREPQVYTLPPSRDELTKNQVSLTCLVKGFYP SDIAVEWESNGQPENNYKTTPPVLDSDGSFFL YSKLTVDKSRWQQGNVFSCSVMHEALHNRF TQKSLSLSPGKGGGGSGGGGSGGGGSGGGG SLPAPKNLVVSRVTEDSARLSWTAPDAAFDS FHIEYAEPWVWGEAIVLTVPGSERSYDLTGL KPGTEYVVFIGGVKGGHNSTPLSAIFTT |
| 862 | PRT | Human | ProteinA3HC80 | QVQLVQSGAEVKKPGSSVKVSCKASGGTFSS YAISWVRQAPGQGLEWMGWISAINGNTNYA QKFQGRVTITADESTSTAYMELSSLRSEDTAV YYCARIWNFLLDYWGQGTLVTVSSASTKGPS VFPLAPSSKSTSGGTAALGCLVKDYFPEPVTV SWNSGALTSGVHTFPAVLQSSGLYSLSSVVT VPSSSLGTQTYICNVNHKPSNTKVDKKVEPK SCDKTHTCPPCPAPPVAGPDVFLFPPKPKDTL MISRTPEVTCVVVDVSHEDPEVKFNWYVDG VEVHNAKTKPREEQYNSTYRVVSVLTVLHQ DWLNGKEYKCKVSNAALPAPIAKTISKAKGQ PREPQVYTLPPSRDELTKNQVSLTCLVKGFYP SDIAVEWESNGQPENNYKTTPPVLDSDGSFFL YSKLTVDKSRWQQGNVFSCSVMHEALHNRF TQKSLSLSPGKGGGGSGGGGSGGGGSGGGG SMLPAPKNLVVSRVTEDSARLSWTAPDAAFD SFPIVYQEWQFYGEAIVLTVPGSERSYDLTGL KPGTEYLVDIYGVKGGSWSYPLSAIFTT |
| 863 | PRT | Human | ProteinA3HC81 | QVQLVQSGAEVKKPGSSVKVSCKASGGTFSS YAISWVRQAPGQGLEWMGWISAINGNTNYA QKFQGRVTITADESTSTAYMELSSLRSEDTAV YYCARIWNFLLDYWGQGTLVTVSSASTKGPS VFPLAPSSKSTSGGTAALGCLVKDYFPEPVTV SWNSGALTSGVHTFPAVLQSSGLYSLSSVVT VPSSSLGTQTYICNVNHKPSNTKVDKKVEPK SCDKTHTCPPCPAPPVAGPDVFLFPPKPKDTL MISRTPEVTCVVVDVSHEDPEVKFNWYVDG VEVHNAKTKPREEQYNSTYRVVSVLTVLHQ DWLNGKEYKCKVSNAALPAPIAKTISKAKGQ PREPQVYTLPPSRDELTKNQVSLTCLVKGFYP SDIAVEWESNGQPENNYKTTPPVLDSDGSFFL YSKLTVDKSRWQQGNVFSCSVMHEALHNRF TQKSLSLSPGKGGGGSGGGGSGGGGSGGGG SLPAPKNLVVSRVTEDSARLSWTAPDAAFDS FPIVYQEWQFYGEAIVLTVPGSERSYDLTGLK PGTEYLVDIYGVKGGSWSYPLSAIFTT |
| 864 | PRT | Human | ProteinA3HC82 | QVQLVQSGAEVKKPGSSVKVSCKASGGTFSS YAISWVRQAPGQGLEWMGWISAINGNTNYA QKFQGRVTITADESTSTAYMELSSLRSEDTAV YYCARIWNFLLDYWGQGTLVTVSSASTKGPS VFPLAPSSKSTSGGTAALGCLVKDYFPEPVTV SWNSGALTSGVHTFPAVLQSSGLYSLSSVVT VPSSSLGTQTYICNVNHKPSNTKVDKKVEPK SCDKTHTCPPCPAPPVAGPDVFLFPPKPKDTL MISRTPEVTCVVVDVSHEDPEVKFNWYVDG VEVHNAKTKPREEQYNSTYRVVSVLTVLHQ |

TABLE 6-continued

Nucleic Acid and Amino Acid Sequences of the Disclosure

| SEQ ID NO: | Type | Species | Description | Sequence |
|---|---|---|---|---|
| | | | | DWLNGKEYKCKVSNAALPAPIAKTISKAKGQ<br>PREPQVYTLPPSRDELTKNQVSLTCLVKGFYP<br>SDIAVEWESNGQPENNYKTTPPVLDSDGSFFL<br>YSKLTVDKSRWQQGNVFSCSVMHEALHNRF<br>TQKSLSLSPGKGGGGSGGGGSGGGGSGGGG<br>SMLPAPKNLVVSRVTEDSARLSWTAPDAAFD<br>SFWITYEEKFYRGEAIVLTVPGSERSYDLTGL<br>KPGTEYKVWIVGVKGGQGSWPLSAIFTTGGG<br>GSGGGGSGGGGSGGGGSMLPAPKNLVVSRV<br>TEDSARLSWTAPDAAFDSFHIEYAEPWVWGE<br>AIVLTVPGSERSYDLTGLKPGTEYVVFIGGVK<br>GGHNSTPLSAIFTT |
| 865 | PRT | Human | ProteinA3HC83 | QVQLVQSGAEVKKPGSSVKVSCKASGGTFSS<br>YAISWVRQAPGQGLEWMGWISAINGNTNYA<br>QKFQGRVTITADESTSTAYMELSSLRSEDTAV<br>YYCARIWNFLLDYWGQGTLVTVSSASTKGPS<br>VFPLAPSSKSTSGGTAALGCLVKDYFPEPVTV<br>SWNSGALTSGVHTFPAVLQSSGLYSLSSVVT<br>VPSSSLGTQTYICNVNHKPSNTKVDKKVEPK<br>SCDKTHTCPPCPAPPVAGPDVFLFPPKPKDTL<br>MISRTPEVTCVVVDVSHEDPEVKFNWYVDG<br>VEVHNAKTKPREEQYNSTYRVVSVLTVLHQ<br>DWLNGKEYKCKVSNAALPAPIAKTISKAKGQ<br>PREPQVYTLPPSRDELTKNQVSLTCLVKGFYP<br>SDIAVEWESNGQPENNYKTTPPVLDSDGSFFL<br>YSKLTVDKSRWQQGNVFSCSVMHEALHNRF<br>TQKSLSLSPGKGGGGSGGGGSGGGGSGGGG<br>SMLPAPKNLVVSRVTEDSARLSWTAPDAAFD<br>SFWITYEEKFYRGEAIVLTVPGSERSYDLTGL<br>KPGTEYKVWIVGVKGGQGSWPLSAIFTTGGG<br>GSGGGGSGGGGSGGGGSLPAPKNLVVSRVT<br>EDSARLSWTAPDAAFDSFHIEYAEPWVWGE<br>AIVLTVPGSERSYDLTGLKPGTEYVVFIGGVK<br>GGHNSTPLSAIFTT |
| 866 | PRT | Human | ProteinA3HC84 | QVQLVQSGAEVKKPGSSVKVSCKASGGTFSS<br>YAISWVRQAPGQGLEWMGWISAINGNTNYA<br>QKFQGRVTITADESTSTAYMELSSLRSEDTAV<br>YYCARIWNFLLDYWGQGTLVTVSSASTKGPS<br>VFPLAPSSKSTSGGTAALGCLVKDYFPEPVTV<br>SWNSGALTSGVHTFPAVLQSSGLYSLSSVVT<br>VPSSSLGTQTYICNVNHKPSNTKVDKKVEPK<br>SCDKTHTCPPCPAPPVAGPDVFLFPPKPKDTL<br>MISRTPEVTCVVVDVSHEDPEVKFNWYVDG<br>VEVHNAKTKPREEQYNSTYRVVSVLTVLHQ<br>DWLNGKEYKCKVSNAALPAPIAKTISKAKGQ<br>PREPQVYTLPPSRDELTKNQVSLTCLVKGFYP<br>SDIAVEWESNGQPENNYKTTPPVLDSDGSFFL<br>YSKLTVDKSRWQQGNVFSCSVMHEALHNRF<br>TQKSLSLSPGKGGGGSGGGGSGGGGSGGGG<br>SMLPAPKNLVVSRVTEDSARLSWTAPDAAFD<br>SFWITYEEKFYRGEAIVLTVPGSERSYDLTGL<br>KPGTEYKVWIVGVKGGQGSWPLSAIFTTGGG<br>GSGGGGSGGGGSGGGGSMLPAPKNLVVSRV<br>TEDSARLSWTAPDAAFDSFPIVYQEWQFYGE<br>AIVLTVPGSERSYDLTGLKPGTEYLVDIYGVK<br>GGSWSYPLSAIFTT |
| 867 | PRT | Human | ProteinA3HC85 | QVQLVQSGAEVKKPGSSVKVSCKASGGTFSS<br>YAISWVRQAPGQGLEWMGWISAINGNTNYA<br>QKFQGRVTITADESTSTAYMELSSLRSEDTAV<br>YYCARIWNFLLDYWGQGTLVTVSSASTKGPS<br>VFPLAPSSKSTSGGTAALGCLVKDYFPEPVTV<br>SWNSGALTSGVHTFPAVLQSSGLYSLSSVVT<br>VPSSSLGTQTYICNVNHKPSNTKVDKKVEPK<br>SCDKTHTCPPCPAPPVAGPDVFLFPPKPKDTL<br>MISRTPEVTCVVVDVSHEDPEVKFNWYVDG<br>VEVHNAKTKPREEQYNSTYRVVSVLTVLHQ<br>DWLNGKEYKCKVSNAALPAPIAKTISKAKGQ<br>PREPQVYTLPPSRDELTKNQVSLTCLVKGFYP<br>SDIAVEWESNGQPENNYKTTPPVLDSDGSFFL<br>YSKLTVDKSRWQQGNVFSCSVMHEALHNRF<br>TQKSLSLSPGKGGGGSGGGGSGGGGSGGGG<br>SMLPAPKNLVVSRVTEDSARLSWTAPDAAFD |

TABLE 6-continued

Nucleic Acid and Amino Acid Sequences of the Disclosure

| SEQ ID NO: | Type | Species | Description | Sequence |
|---|---|---|---|---|
| | | | | SFWITYEEKFYRGEAIVLTVPGSERSYDLTGL KPGTEYKVWIVGVKGGQGSWPLSAIFTTGGG GSGGGGSGGGGSGGGGSLPAPKNLVVSRVT EDSARLSWTAPDAAFDSFPIVYQEWQFYGEA IVLTVPGSERSYDLTGLKPGTEYLVDIYGVKG GSWSYPLSAIFTT |
| 868 | PRT | Human | ProteinA3HC86 | QVQLVQSGAEVKKPGSSVKVSCKASGGTFSS YAISWVRQAPGQGLEWMGWISAINGNTNYA QKFQGRVTITADESTSTAYMELSSLRSEDTAV YYCARIWNFLLDYWGQGTLVTVSSASTKGPS VFPLAPSSKSTSGGTAALGCLVKDYFPEPVTV SWNSGALTSGVHTFPAVLQSSGLYSLSSVVT VPSSSLGTQTYICNVNHKPSNTKVDKKVEPK SCDKTHTCPPCPAPPVAGPDVFLFPPKPKDTL MISRTPEVTCVVVDVSHEDPEVKFNWYVDG VEVHNAKTKPREEQYNSTYRVVSVLTVLHQ DWLNGKEYKCKVSNAALPAPIAKTISKAKGQ PREPQVYTLPPSRDELTKNQVSLTCLVKGFYP SDIAVEWESNGQPENNYKTTPPVLDSDGSFFL YSKLTVDKSRWQQGNVFSCSVMHEALHNRF TQKSLSLSPGKGGGGSGGGGSGGGGSGGGG SMLPAPKNLVVSRVTEDSARLSWTAPDAAFD SPHIEYAEPWVWGEAIVLTVPGSERSYDLTG LKPGTEYVVFIGGVKGGHNSTPLSAIFTTGGG GSGGGGSGGGGSGGGGSMLPAPKNLVVSRV TEDSARLSWTAPDAAFDSFWITYEEKFYRGE AIVLTVPGSERSYDLTGLKPGTEYKVWIVGV KGGQGSWPLSAIFTT |
| 869 | PRT | Human | ProteinA3HC87 | QVQLVQSGAEVKKPGSSVKVSCKASGGTFSS YAISWVRQAPGQGLEWMGWISAINGNTNYA QKFQGRVTITADESTSTAYMELSSLRSEDTAV YYCARIWNFLLDYWGQGTLVTVSSASTKGPS VFPLAPSSKSTSGGTAALGCLVKDYFPEPVTV SWNSGALTSGVHTFPAVLQSSGLYSLSSVVT VPSSSLGTQTYICNVNHKPSNTKVDKKVEPK SCDKTHTCPPCPAPPVAGPDVFLFPPKPKDTL MISRTPEVTCVVVDVSHEDPEVKFNWYVDG VEVHNAKTKPREEQYNSTYRVVSVLTVLHQ DWLNGKEYKCKVSNAALPAPIAKTISKAKGQ PREPQVYTLPPSRDELTKNQVSLTCLVKGFYP SDIAVEWESNGQPENNYKTTPPVLDSDGSFFL YSKLTVDKSRWQQGNVFSCSVMHEALHNRF TQKSLSLSPGKGGGGSGGGGSGGGGSGGGG SLPAPKNLVVSRVTEDSARLSWTAPDAAFDS FHIEYAEPWVWGEAIVLTVPGSERSYDLTGL KPGTEYVVFIGGVKGGHNSTPLSAIFTTGGGG SGGGGSGGGGSGGGGSMLPAPKNLVVSRVT EDSARLSWTAPDAAFDSFWITYEEKFYRGEA IVLTVPGSERSYDLTGLKPGTEYKVWIVGVK GGQGSWPLSAIFTT |
| 870 | PRT | Human | ProteinA3HC88 | QVQLVQSGAEVKKPGSSVKVSCKASGGTFSS YAISWVRQAPGQGLEWMGWISAINGNTNYA QKFQGRVTITADESTSTAYMELSSLRSEDTAV YYCARIWNFLLDYWGQGTLVTVSSASTKGPS VFPLAPSSKSTSGGTAALGCLVKDYFPEPVTV SWNSGALTSGVHTFPAVLQSSGLYSLSSVVT VPSSSLGTQTYICNVNHKPSNTKVDKKVEPK SCDKTHTCPPCPAPPVAGPDVFLFPPKPKDTL MISRTPEVTCVVVDVSHEDPEVKFNWYVDG VEVHNAKTKPREEQYNSTYRVVSVLTVLHQ DWLNGKEYKCKVSNAALPAPIAKTISKAKGQ PREPQVYTLPPSRDELTKNQVSLTCLVKGFYP SDIAVEWESNGQPENNYKTTPPVLDSDGSFFL YSKLTVDKSRWQQGNVFSCSVMHEALHNRF TQKSLSLSPGKGGGGSGGGGSGGGGSGGGG SMLPAPKNLVVSRVTEDSARLSWTAPDAAFD SPIVYQEWQFYGEAIVLTVPGSERSYDLTGL KPGTEYLVDIYGVKGGSWSYPLSAIFTTGGG GSGGGGSGGGGSGGGGSMLPAPKNLVVSRV TEDSARLSWTAPDAAFDSFWITYEEKFYRGE AIVLTVPGSERSYDLTGLKPGTEYKVWIVGV KGGQGSWPLSAIFTT |

TABLE 6-continued

Nucleic Acid and Amino Acid Sequences of the Disclosure

| SEQ ID NO: | Type | Species | Description | Sequence |
|---|---|---|---|---|
| 871 | PRT | Human | ProteinA3HC89 | QVQLVQSGAEVKKPGSSVKVSCKASGGTFSS YAISWVRQAPGQGLEWMGWISAINGNTNYA QKFQGRVTITADESTSTAYMELSSLRSEDTAV YYCARIWNFLLDYWGQGTLVTVSSASTKGPS VFPLAPSSKSTSGGTAALGCLVKDYFPEPVTV SWNSGALTSGVHTFPAVLQSSGLYSLSSVVT VPSSSLGTQTYICNVNHKPSNTKVDKKVEPK SCDKTHTCPPCPAPPVAGPDVFLFPPKPKDTL MISRTPEVTCVVVDVSHEDPEVKFNWYVDG VEVHNAKTKPREEQYNSTYRVVSVLTVLHQ DWLNGKEYKCKVSNAALPAPIAKTISKAKGQ PREPQVYTLPPSRDELTKNQVSLTCLVKGFYP SDIAVEWESNGQPENNYKTTPPVLDSDGSFFL YSKLTVDKSRWQQGNVFSCSVMHEALHNRF TQKSLSLSPGKGGGGSGGGGSGGGGSGGGG SLPAPKNLVVSRVTEDSARLSWTAPDAAFDS FPIVYQEWQFYGEAIVLTVPGSERSYDLTGLK PGTEYLVDIYGVKGGSWSYPLSAIFTTGGGG SGGGGSGGGGSGGGGSMLPAPKNLVVSRVT EDSARLSWTAPDAAFDSFWITYEEKFYRGEA IVLTVPGSERSYDLTGLKPGTEYKVWIVGVK GGQGSWPLSAIFTT |
| 872 | PRT | Human | ProteinA9HC90 | EVQLVQSGAEVKKPGESLKISCKGSGYSFTSY WIGWVRQMPGKGLEWMGIIYPGDSDTRYSP SFQGQVTISADKSISTAYLQWSSLKASDTAM YYCARWSYSQYSGWLDYWGQGTLVTVSSA STKGPSVFPLAPSSKSTSGGTAALGCLVKDYF PEPVTVSWNSGALTSGVHTFPAVLQSSGLYS LSSVVTVPSSSLGTQTYICNVNHKPSNTKVDK KVEPKSCDKTHTCPPCPAPPVAGPDVFLFPPK PKDTLMISRTPEVTCVVVDVSHEDPEVKFNW YVDGVEVHNAKTKPREEQYNSTYRVVSVLT VLHQDWLNGKEYKCKVSNAALPAPIAKTISK AKGQPREPQVYTLPPSRDELTKNQVSLTCLV KGFYPSDIAVEWESNGQPENNYKTTPPVLDS DGSFFLYSKLTVDKSRWQQGNVFSCSVMHE ALHNRFTQKSLSLSPGKGGGGSGGGGSGGG GSGGGGSMLPAPKNLVVSRVTEDSARLSWT APDAAFDSFHIEYAEPWVWGEAIVLTVPGSE RSYDLTGLKPGTEYVVFIGGVKGGHNSTPLS AIFTT |
| 873 | PRT | Human | ProteinA9HC91 | EVQLVQSGAEVKKPGESLKISCKGSGYSFTSY WIGWVRQMPGKGLEWMGIIYPGDSDTRYSP SFQGQVTISADKSISTAYLQWSSLKASDTAM YYCARWSYSQYSGWLDYWGQGTLVTVSSA STKGPSVFPLAPSSKSTSGGTAALGCLVKDYF PEPVTVSWNSGALTSGVHTFPAVLQSSGLYS LSSVVTVPSSSLGTQTYICNVNHKPSNTKVDK KVEPKSCDKTHTCPPCPAPPVAGPDVFLFPPK PKDTLMISRTPEVTCVVVDVSHEDPEVKFNW YVDGVEVHNAKTKPREEQYNSTYRVVSVLT VLHQDWLNGKEYKCKVSNAALPAPIAKTISK AKGQPREPQVYTLPPSRDELTKNQVSLTCLV KGFYPSDIAVEWESNGQPENNYKTTPPVLDS DGSFFLYSKLTVDKSRWQQGNVFSCSVMHE ALHNRFTQKSLSLSPGKGGGGSGGGGSGGG GSGGGGSLPAPKNLVVSRVTEDSARLSWTAP DAAFDSFHIEYAEPWVWGEAIVLTVPGSERS YDLTGLKPGTEYVVFIGGVKGGHNSTPLSAIF TT |
| 874 | PRT | Human | ProteinA9HC92 | EVQLVQSGAEVKKPGESLKISCKGSGYSFTSY WIGWVRQMPGKGLEWMGIIYPGDSDTRYSP SFQGQVTISADKSISTAYLQWSSLKASDTAM YYCARWSYSQYSGWLDYWGQGTLVTVSSA STKGPSVFPLAPSSKSTSGGTAALGCLVKDYF PEPVTVSWNSGALTSGVHTFPAVLQSSGLYS LSSVVTVPSSSLGTQTYICNVNHKPSNTKVDK KVEPKSCDKTHTCPPCPAPPVAGPDVFLFPPK PKDTLMISRTPEVTCVVVDVSHEDPEVKFNW YVDGVEVHNAKTKPREEQYNSTYRVVSVLT VLHQDWLNGKEYKCKVSNAALPAPIAKTISK |

TABLE 6-continued

Nucleic Acid and Amino Acid Sequences of the Disclosure

| SEQ ID NO: | Type | Species | Description | Sequence |
|---|---|---|---|---|
| | | | | AKGQPREPQVYTLPPSRDELTKNQVSLTCLV KGFYPSDIAVEWESNGQPENNYKTTPPVLDS DGSFFLYSKLTVDKSRWQQGNVFSCSVMHE ALHNRFTQKSLSLSPGKGGGGSGGGGSGGG GSGGGGSMLPAPKNLVVSRVTEDSARLSWT APDAAFDSFPIVYQEWQFYGEAIVLTVPGSER SYDLTGLKPGTEYLVDIYGVKGGSWSYPLSA IFTT |
| 875 | PRT | Human | ProteinA9HC93 | EVQLVQSGAEVKKPGESLKISCKGSGYSFTSY WIGWVRQMPGKGLEWMGIIYPGDSDTRYSP SFQGQVTISADKSISTAYLQWSSLKASDTAM YYCARWSYSQYSGWLDYWGQGTLVTVSSA STKGPSVFPLAPSSKSTSGGTAALGCLVKDYF PEPVTVSWNSGALTSGVHTFPAVLQSSGLYS LSSVVTVPSSSLGTQTYICNVNHKPSNTKVDK KVEPKSCDKTHTCPPCPAPPVAGPDVFLFPPK PKDTLMISRTPEVTCVVVDVSHEDPEVKFNW YVDGVEVHNAKTKPREEQYNSTYRVVSVLT VLHQDWLNGKEYKCKVSNAALPAPIAKTISK AKGQPREPQVYTLPPSRDELTKNQVSLTCLV KGFYPSDIAVEWESNGQPENNYKTTPPVLDS DGSFFLYSKLTVDKSRWQQGNVFSCSVMHE ALHNRFTQKSLSLSPGKGGGGSGGGGSGGG GSGGGGSLPAPKNLVVSRVTEDSARLSWTAP DAAFDSFPIVYQEWQFYGEAIVLTVPGSERSY DLTGLKPGTEYLVDIYGVKGGSWSYPLSAIFTT |
| 876 | PRT | Human | ProteinA9HC94 | EVQLVQSGAEVKKPGESLKISCKGSGYSFTSY WIGWVRQMPGKGLEWMGIIYPGDSDTRYSP SFQGQVTISADKSISTAYLQWSSLKASDTAM YYCARWSYSQYSGWLDYWGQGTLVTVSSA STKGPSVFPLAPSSKSTSGGTAALGCLVKDYF PEPVTVSWNSGALTSGVHTFPAVLQSSGLYS LSSVVTVPSSSLGTQTYICNVNHKPSNTKVDK KVEPKSCDKTHTCPPCPAPPVAGPDVFLFPPK PKDTLMISRTPEVTCVVVDVSHEDPEVKFNW YVDGVEVHNAKTKPREEQYNSTYRVVSVLT VLHQDWLNGKEYKCKVSNAALPAPIAKTISK AKGQPREPQVYTLPPSRDELTKNQVSLTCLV KGFYPSDIAVEWESNGQPENNYKTTPPVLDS DGSFFLYSKLTVDKSRWQQGNVFSCSVMHE ALHNRFTQKSLSLSPGKGGGGSGGGGSGGG GSGGGGSMLPAPKNLVVSRVTEDSARLSWT APDAAFDSFWITYEEKFYRGEAIVLTVPGSER SYDLTGLKPGTEYKVWIVGVKGGQGSWPLS AIFTTGGGSGGGSGGGGSGGGGSMLPAPK NLVVSRVTEDSARLSWTAPDAAFDSFHIEYA EPWVWGEAIVLTVPGSERSYDLTGLKPGTEY VVFIGGVKGGHNSTPLSAIFTT |
| 877 | PRT | Human | ProteinA9HC95 | EVQLVQSGAEVKKPGESLKISCKGSGYSFTSY WIGWVRQMPGKGLEWMGIIYPGDSDTRYSP SFQGQVTISADKSISTAYLQWSSLKASDTAM YYCARWSYSQYSGWLDYWGQGTLVTVSSA STKGPSVFPLAPSSKSTSGGTAALGCLVKDYF PEPVTVSWNSGALTSGVHTFPAVLQSSGLYS LSSVVTVPSSSLGTQTYICNVNHKPSNTKVDK KVEPKSCDKTHTCPPCPAPPVAGPDVFLFPPK PKDTLMISRTPEVTCVVVDVSHEDPEVKFNW YVDGVEVHNAKTKPREEQYNSTYRVVSVLT VLHQDWLNGKEYKCKVSNAALPAPIAKTISK AKGQPREPQVYTLPPSRDELTKNQVSLTCLV KGFYPSDIAVEWESNGQPENNYKTTPPVLDS DGSFFLYSKLTVDKSRWQQGNVFSCSVMHE ALHNRFTQKSLSLSPGKGGGGSGGGGSGGG GSGGGGSMLPAPKNLVVSRVTEDSARLSWT APDAAFDSFWITYEEKFYRGEAIVLTVPGSER SYDLTGLKPGTEYKVWIVGVKGGQGSWPLS AIFTTGGGSGGGSGGGGSGGGGSLPAPKN LVVSRVTEDSARLSWTAPDAAFDSFHIEYAE PWVWGEAIVLTVPGSERSYDLTGLKPGTEYV VFIGGVKGGHNSTPLSAIFTT |

TABLE 6-continued

Nucleic Acid and Amino Acid Sequences of the Disclosure

| SEQ ID NO: | Type | Species | Description | Sequence |
|---|---|---|---|---|
| 878 | PRT | Human | ProteinA9HC96 | EVQLVQSGAEVKKPGESLKISCKGSGYSFTSY WIGWVRQMPGKGLEWMGIIYPGDSDTRYSP SFQGQVTISADKSISTAYLQWSSLKASDTAM YYCARWSYSQYSGWLDYWGQGTLVTVSSA STKGPSVFPLAPSSKSTSGGTAALGCLVKDYF PEPVTVSWNSGALTSGVHTFPAVLQSSGLYS LSSVVTVPSSSLGTQTYICNVNHKPSNTKVDK KVEPKSCDKTHTCPPCPAPPVAGPDVFLFPPK PKDTLMISRTPEVTCVVVDVSHEDPEVKFNW YVDGVEVHNAKTKPREEQYNSTYRVVSVLT VLHQDWLNGKEYKCKVSNAALPAPIAKTISK AKGQPREPQVYTLPPSRDELTKNQVSLTCLV KGFYPSDIAVEWESNGQPENNYKTTPPVLDS DGSFFLYSKLTVDKSRWQQGNVFSCSVMHE ALHNRFTQKSLSLSPGKGGGGSGGGGSGGG GSGGGGSMLPAPKNLVVSRVTEDSARLSWT APDAAFDSFWITYEEKFYRGEAIVLTVPGSER SYDLTGLKPGTEYKVWIVGVKGGQGSWPLS AIFTTGGGGSGGGGSGGGGSGGGGSMLPAPK NLVVSRVTEDSARLSWTAPDAAFDSFPIVYQ EWQFYGEAIVLTVPGSERSYDLTGLKPGTEY LVDIYGVKGGSWSYPLSAIFTT |
| 879 | PRT | Human | ProteinA9HC97 | EVQLVQSGAEVKKPGESLKISCKGSGYSFTSY WIGWVRQMPGKGLEWMGIIYPGDSDTRYSP SFQGQVTISADKSISTAYLQWSSLKASDTAM YYCARWSYSQYSGWLDYWGQGTLVTVSSA STKGPSVFPLAPSSKSTSGGTAALGCLVKDYF PEPVTVSWNSGALTSGVHTFPAVLQSSGLYS LSSVVTVPSSSLGTQTYICNVNHKPSNTKVDK KVEPKSCDKTHTCPPCPAPPVAGPDVFLFPPK PKDTLMISRTPEVTCVVVDVSHEDPEVKFNW YVDGVEVHNAKTKPREEQYNSTYRVVSVLT VLHQDWLNGKEYKCKVSNAALPAPIAKTISK AKGQPREPQVYTLPPSRDELTKNQVSLTCLV KGFYPSDIAVEWESNGQPENNYKTTPPVLDS DGSFFLYSKLTVDKSRWQQGNVFSCSVMHE ALHNRFTQKSLSLSPGKGGGGSGGGGSGGG GSGGGGSMLPAPKNLVVSRVTEDSARLSWT APDAAFDSFWITYEEKFYRGEAIVLTVPGSER SYDLTGLKPGTEYKVWIVGVKGGQGSWPLS AIFTTGGGGSGGGGSGGGGSGGGGSLPAPKN LVVSRVTEDSARLSWTAPDAAFDSFPIVYQE WQFYGEAIVLTVPGSERSYDLTGLKPGTEYL VDIYGVKGGSWSYPLSAIFTT |
| 880 | PRT | Human | ProteinA9HC98 | EVQLVQSGAEVKKPGESLKISCKGSGYSFTSY WIGWVRQMPGKGLEWMGIIYPGDSDTRYSP SFQGQVTISADKSISTAYLQWSSLKASDTAM YYCARWSYSQYSGWLDYWGQGTLVTVSSA STKGPSVFPLAPSSKSTSGGTAALGCLVKDYF PEPVTVSWNSGALTSGVHTFPAVLQSSGLYS LSSVVTVPSSSLGTQTYICNVNHKPSNTKVDK KVEPKSCDKTHTCPPCPAPPVAGPDVFLFPPK PKDTLMISRTPEVTCVVVDVSHEDPEVKFNW YVDGVEVHNAKTKPREEQYNSTYRVVSVLT VLHQDWLNGKEYKCKVSNAALPAPIAKTISK AKGQPREPQVYTLPPSRDELTKNQVSLTCLV KGFYPSDIAVEWESNGQPENNYKTTPPVLDS DGSFFLYSKLTVDKSRWQQGNVFSCSVMHE ALHNRFTQKSLSLSPGKGGGGSGGGGSGGG GSGGGGSMLPAPKNLVVSRVTEDSARLSWT APDAAFDSFHIEYAEPWVWGEAIVLTVPGSE RSYDLTGLKPGTEYVVFIGGVKGGHNSTPLS AIFTTGGGGSGGGGSGGGGSGGGGSMLPAPK NLVVSRVTEDSARLSWTAPDAAFDSFWITYE EKFYRGEAIVLTVPGSERSYDLTGLKPGTEYK VWIVGVKGGQGSWPLSAIFTT |
| 881 | PRT | Human | ProteinA9HC99 | EVQLVQSGAEVKKPGESLKISCKGSGYSFTSY WIGWVRQMPGKGLEWMGIIYPGDSDTRYSP SFQGQVTISADKSISTAYLQWSSLKASDTAM YYCARWSYSQYSGWLDYWGQGTLVTVSSA STKGPSVFPLAPSSKSTSGGTAALGCLVKDYF |

TABLE 6-continued

Nucleic Acid and Amino Acid Sequences of the Disclosure

| SEQ ID NO: | Type | Species | Description | Sequence |
|---|---|---|---|---|
| | | | | PEPVTVSWNSGALTSGVHTFPAVLQSSGLYS LSSVVTVPSSSLGTQTYICNVNHKPSNTKVDK KVEPKSCDKTHTCPPCPAPPVAGPDVFLFPPK PKDTLMISRTPEVTCVVVDVSHEDPEVKFNW YVDGVEVHNAKTKPREEQYNSTYRVVSVLT VLHQDWLNGKEYKCKVSNAALPAPIAKTISK AKGQPREPQVYTLPPSRDELTKNQVSLTCLV KGFYPSDIAVEWESNGQPENNYKTTPPVLDS DGSFFLYSKLTVDKSRWQQGNVFSCSVMHE ALHNRFTQKSLSLSPGKGGGGSGGGGSGGG GSGGGGSLPAPKNLVVSRVTEDSARLSWTAP DAAFDSFHIEYAEPWVWGEAIVLTVPGSERS YDLTGLKPGTEYVVFIGGVKGGHNSTPLSAIF TTGGGGSGGGGSGGGGSGGGGSMLPAPKNL VVSRVTEDSARLSWTAPDAAFDSFWITYEEK FYRGEAIVLTVPGSERSYDLTGLKPGTEYKV WIVGVKGGQGSWPLSAIFTT |
| 882 | PRT | Human | ProteinA9HC100 | EVQLVQSGAEVKKPGESLKISCKGSGYSFTSY WIGWVRQMPGKGLEWMGIIYPGDSDTRYSP SFQGQVTISADKSISTAYLQWSSLKASDTAM YYCARWSYSQYSGWLDYWGQGTLVTVSSA STKGPSVFPLAPSSKSTSGGTAALGCLVKDYF PEPVTVSWNSGALTSGVHTFPAVLQSSGLYS LSSVVTVPSSSLGTQTYICNVNHKPSNTKVDK KVEPKSCDKTHTCPPCPAPPVAGPDVFLFPPK PKDTLMISRTPEVTCVVVDVSHEDPEVKFNW YVDGVEVHNAKTKPREEQYNSTYRVVSVLT VLHQDWLNGKEYKCKVSNAALPAPIAKTISK AKGQPREPQVYTLPPSRDELTKNQVSLTCLV KGFYPSDIAVEWESNGQPENNYKTTPPVLDS DGSFFLYSKLTVDKSRWQQGNVFSCSVMHE ALHNRFTQKSLSLSPGKGGGGSGGGGSGGG GSGGGGSMLPAPKNLVVSRVTEDSARLSWT APDAAFDSFPIVYQEWQFYGEAIVLTVPGSER SYDLTGLKPGTEYLVDIYGVKGGSWSYPLSA IFTTGGGGSGGGGSGGGGSGGGGSMLPAPKN LVVSRVTEDSARLSWTAPDAAFDSFWITYEE KFYRGEAIVLTVPGSERSYDLTGLKPGTEYK VWIVGVKGGQGSWPLSAIFTT |
| 883 | PRT | Human | ProteinA9HC101 | EVQLVQSGAEVKKPGESLKISCKGSGYSFTSY WIGWVRQMPGKGLEWMGIIYPGDSDTRYSP SFQGQVTISADKSISTAYLQWSSLKASDTAM YYCARWSYSQYSGWLDYWGQGTLVTVSSA STKGPSVFPLAPSSKSTSGGTAALGCLVKDYF PEPVTVSWNSGALTSGVHTFPAVLQSSGLYS LSSVVTVPSSSLGTQTYICNVNHKPSNTKVDK KVEPKSCDKTHTCPPCPAPPVAGPDVFLFPPK PKDTLMISRTPEVTCVVVDVSHEDPEVKFNW YVDGVEVHNAKTKPREEQYNSTYRVVSVLT VLHQDWLNGKEYKCKVSNAALPAPIAKTISK AKGQPREPQVYTLPPSRDELTKNQVSLTCLV KGFYPSDIAVEWESNGQPENNYKTTPPVLDS DGSFFLYSKLTVDKSRWQQGNVFSCSVMHE ALHNRFTQKSLSLSPGKGGGGSGGGGSGGG GSGGGGSLPAPKNLVVSRVTEDSARLSWTAP DAAFDSFPIVYQEWQFYGEAIVLTVPGSERSY DLTGLKPGTEYLVDIYGVKGGSWSYPLSAIFT TGGGGSGGGGSGGGGSGGGGSMLPAPKNLV VSRVTEDSARLSWTAPDAAFDSFWITYEEKF YRGEAIVLTVPGSERSYDLTGLKPGTEYKVW IVGVKGGQGSWPLSAIFTT |
| 884 | PRT | Human | RSVHC102 | QITLKESGPTLVKPTQTLTLTCTFSGFSLSTSG MGVSWIRQPPGKALEWLAHIYWDDDKRYNP SLKSRLTITKDTSKNQVVLTMTNMDPVDTAT YYCARLYGFTYGFAYWGQGTLVTVSSASTK GPSVFPLAPSSKSTSGGTAALGCLVKDYFPEP VTVSWNSGALTSGVHTFPAVLQSSGLYSLSS VVTVPSSSLGTQTYICNVNHKPSNTKVDKKV EPKSCDKTHTCPPCPAPELLGGPSVFLFPPKP KDTLMISRTPEVTCVVVDVSHEDPEVKFNWY VDGVEVHNAKTKPREEQYNSTYRVVSVLTV LHQDWLNGKEYKCKVSNKALPAPIEKTISKA |

TABLE 6-continued

Nucleic Acid and Amino Acid Sequences of the Disclosure

| SEQ ID NO: | Type | Species | Description | Sequence |
|---|---|---|---|---|
| | | | | KGQPREPQVYTLPPSRDELTKNQVSLTCLVK GFYPSDIAVEWESNGQPENNYKTTPPVLDSD GSFFLYSKLTVDKSRWQQGNVFSCSVMHEA LHNHYTQKSLSLSPGKGGGGSGGGGSGGGG SGGGGSLPAPKNLVVSRVTEDSARLSWTAPD AAFDSFLIQYQESEKVGEAIVLTVPGSERSYD LTGLKPGTEYTVSIYGVKGGHRSNPLSAIFTT |
| 885 | PRT | Human | RSVHC103 | QITLKESGPTLVKPTQTLTLTCTFSGFSLSTSG MGVSWIRQPPGKALEWLAHIYWDDDKRYNP SLKSRLTITKDTSKNQVVLTMTNMDPVDTAT YYCARLYGFTYGFAYWGQGTLVTVSSASTK GPSVFPLAPSSKSTSGGTAALGCLVKDYFPEP VTVSWNSGALTSGVHTFPAVLQSSGLYSLSS VVTVPSSSLGTQTYICNVNHKPSNTKVDKKV EPKSCDKTHTCPPCPAPELLGGPSVFLFPPKP KDTLMISRTPEVTCVVVDVSHEDPEVKFNWY VDGVEVHNAKTKPREEQYNSTYRVVSVLTV LHQDWLNGKEYKCKVSNKALPAPIEKTISKA KGQPREPQVYTLPPSRDELTKNQVSLTCLVK GFYPSDIAVEWESNGQPENNYKTTPPVLDSD GSFFLYSKLTVDKSRWQGNVFSCSVMHEA LHNRFTQKSLSLSPGKGGGGSGGGGSGGGGS GGGGSLPAPKNLVVSRVTEDSARLSWTAPDA AFDSFLIQYQESEKVGEAIVLTVPGSERSYDL TGLKPGTEYTVSIYGVKGGHRSNPLSAIFTT |
| 886 | PRT | Human | RSVHC104 | QITLKESGPTLVKPTQTLTLTCTFSGFSLSTSG MGVSWIRQPPGKALEWLAHIYWDDDKRYNP SLKSRLTITKDTSKNQVVLTMTNMDPVDTAT YYCARLYGFTYGFAYWGQGTLVTVSSASTK GPSVFPLAPSSKSTSGGTAALGCLVKDYFPEP VTVSWNSGALTSGVHTFPAVLQSSGLYSLSS VVTVPSSSLGTQTYICNVNHKPSNTKVDKKV EPKSCDKTHTCPPCPAPPVAGPDVFLFPPKPK DTLMISRTPEVTCVVVDVSHEDPEVKFNWYV DGVEVHNAKTKPREEQYNSTYRVVSVLTVL HQDWLNGKEYKCKVSNAALPAPIAKTISKAK GQPREPQVYTLPPSRDELTKNQVSLTCLVKG FYPSDIAVEWESNGQPENNYKTTPPVLDSDG SFFLYSKLTVDKSRWQQGNVFSCSVMHEAL HNHYTQKSLSLSPGKGGGGSGGGGSGGGGS GGGGSLPAPKNLVVSRVTEDSARLSWTAPDA AFDSFLIQYQESEKVGEAIVLTVPGSERSYDL TGLKPGTEYTVSIYGVKGGHRSNPLSAIFTT |
| 887 | PRT | Human | CR-5133HC113 | EVQLVETGGGLVKPGGSLRLSCSASRFSFRD YYMTWIRQAPGKGPEWVSHISGSGSTIYYAD SVRGRFTISRDNAKSSLYLQMDSLQADDTAV YYCARGGRATSYYWVHWGPGTLVTVSSAST KGPSVFPLAPSSKSTSGGTAALGCLVKDYFPE PVTVSWNSGALTSGVHTFPAVLQSSGLYSLS SVVTVPSSSLGTQTYICNVNHKPSNTKVDKK VEPKSCDKTHTCPPCPAPPVAGPDVFLFPPKP KDTLMISRTPEVTCVVVDVSHEDPEVKFNWY VDGVEVHNAKTKPREEQYNSTYRVVSVLTV LHQDWLNGKEYKCKVSNAALPAPIAKTISKA KGQPREPQVYTLPPSRDELTKNQVSLTCLVK GFYPSDIAVEWESNGQPENNYKTTPPVLDSD GSFFLYSKLTVDKSRWQQGNVFSCSVMHEA LHNHYTQKSLSLSPGKGGGGSGGGGSGGGG SGGGGSMLPAPKNLVVSRVTEDSARLSWTAP DAAFDSFHIEYAEPWVWGEAIVLTVPGSERS YDLTGLKPGTEYVVFIGGVKGGHNSTPLSAIF TTGGGGSGGGGSGGGGSGGGGSMLPAPKNL VVSRVTEDSARLSWTAPDAAFDSFWITYEEK FYRGEAIVLTVPGSERSYDLTGLKPGTEYKV WIVGVKGGQGSWPLSAIFTT |
| 888 | PRT | Human | CR-5133HC114 | EVQLVETGGGLVKPGGSLRLSCSASRFSFRD YYMTWIRQAPGKGPEWVSHISGSGSTIYYAD SVRGRFTISRDNAKSSLYLQMDSLQADDTAV YYCARGGRATSYYWVHWGPGTLVTVSSAST KGPSVFPLAPSSKSTSGGTAALGCLVKDYFPE PVTVSWNSGALTSGVHTFPAVLQSSGLYSLS |

TABLE 6-continued

Nucleic Acid and Amino Acid Sequences of the Disclosure

| SEQ ID NO: | Type | Species | Description | Sequence |
|---|---|---|---|---|
| | | | | SVVTVPSSSLGTQTYICNVNHKPSNTKVDKK VEPKSCDKTHTCPPCPAPPVAGPDVFLFPPKP KDTLMISRTPEVTCVVVDVSHEDPEVKFNWY VDGVEVHNAKTKPREEQYNSTYRVVSVLTV LHQDWLNGKEYKCKVSNAALPAPIAKTISKA KGQPREPQVYTLPPSRDELTKNQVSLTCLVK GFYPSDIAVEWESNGQPENNYKTTPPVLDSD GSFFLYSKLTVDKSRWQQGNVFSCSVMHEA LHNHYTQKSLSLSPGKGGGGSGGGGSGGGG SGGGGSLPAPKNLVVSRVTEDSARLSWTAPD AAFDSFHIEYAEPWVWGEAIVLTVPGSERSY DLTGLKPGTEYVVFIGGVKGGHNSTPLSAIFT TGGGGSGGGGSGGGGSGGGGSMLPAPKNLV VSRVTEDSARLSWTAPDAAFDSFWITYEEKF YRGEAIVLTVPGSERSYDLTGLKPGTEYKVW IVGVKGGQGSWPLSAIFTT |
| 889 | PRT | Human | ProteinA3HC115 | QVQLVQSGAEVKKPGSSVKVSCKASGGTFSS YAISWVRQAPGQGLEWMGWISAINGNTNYA QKFQGRVTITADESTSTAYMELSSLRSEDTAV YYCARIWNFLLDYWGQGTLVTVSSASTKGPS VFPLAPSSKSTSGGTAALGCLVKDYFPEPVTV SWNSGALTSGVHTFPAVLQSSGLYSLSSVVT VPSSSLGTQTYICNVNHKPSNTKVDKKVEPK SCDKTHTCPPCPAPPVAGPDVFLFPPKPKDTL MISRTPEVTCVVVDVSHEDPEVKFNWYVDG VEVHNAKTKPREEQYNSTYRVVSVLTVLHQ DWLNGKEYKCKVSNAALPAPIAKTISKAKGQ PREPQVYTLPPSRDELTKNQVSLTCLVKGFYP SDIAVEWESNGQPENNYKTTPPVLDSDGSFFL YSKLTVDKSRWQQGNVFSCSVMHEALHNHY TQKSLSLSPGKGGGGSGGGGSGGGGSGGGG SMLPAPKNLVVSRVTEDSARLSWTAPDAAFD SFHIEYAEPWVWGEAIVLTVPGSERSYDLTG LKPGTEYVVFIGGVKGGHNSTPLSAIFTTGGG GSGGGGSGGGGSGGGGSMLPAPKNLVVSRV TEDSARLSWTAPDAAFDSFWITYEEKFYRGE AIVLTVPGSERSYDLTGLKPGTEYKVWIVGV KGGQGSWPLSAIFTT |
| 890 | PRT | Human | ProteinA3HC116 | QVQLVQSGAEVKKPGSSVKVSCKASGGTFSS YAISWVRQAPGQGLEWMGWISAINGNTNYA QKFQGRVTITADESTSTAYMELSSLRSEDTAV YYCARIWNFLLDYWGQGTLVTVSSASTKGPS VFPLAPSSKSTSGGTAALGCLVKDYFPEPVTV SWNSGALTSGVHTFPAVLQSSGLYSLSSVVT VPSSSLGTQTYICNVNHKPSNTKVDKKVEPK SCDKTHTCPPCPAPPVAGPDVFLFPPKPKDTL MISRTPEVTCVVVDVSHEDPEVKFNWYVDG VEVHNAKTKPREEQYNSTYRVVSVLTVLHQ DWLNGKEYKCKVSNAALPAPIAKTISKAKGQ PREPQVYTLPPSRDELTKNQVSLTCLVKGFYP SDIAVEWESNGQPENNYKTTPPVLDSDGSFFL YSKLTVDKSRWQQGNVFSCSVMHEALHNHY TQKSLSLSPGKGGGGSGGGGSGGGGSGGGG SLPAPKNLVVSRVTEDSARLSWTAPDAAFDS FHIEYAEPWVWGEAIVLTVPGSERSYDLTGL KPGTEYVVFIGGVKGGHNSTPLSAIFTTGGGG SGGGGSGGGGSGGGGSMLPAPKNLVVSRVT EDSARLSWTAPDAAFDSFWITYEEKFYRGEA IVLTVPGSERSYDLTGLKPGTEYKVWIVGVK GGQGSWPLSAIFTT |
| 891 | PRT | Human | ProteinA9HC117 | EVQLVQSGAEVKKPGESLKISCKGSGYSFTSY WIGWVRQMPGKGLEWMGIIYPGDSDTRYSP SFQGQVTISADKSISTAYLQWSSLKASDTAM YYCARWSYSQYSGWLDYWGQGTLVTVSSA STKGPSVFPLAPSSKSTSGGTAALGCLVKDYF PEPVTVSWNSGALTSGVHTFPAVLQSSGLYS LSSVVTVPSSSLGTQTYICNVNHKPSNTKVDK KVEPKSCDKTHTCPPCPAPPVAGPDVFLFPPK PKDTLMISRTPEVTCVVVDVSHEDPEVKFNW YVDGVEVHNAKTKPREEQYNSTYRVVSVLT VLHQDWLNGKEYKCKVSNAALPAPIAKTISK AKGQPREPQVYTLPPSRDELTKNQVSLTCLV |

TABLE 6-continued

Nucleic Acid and Amino Acid Sequences of the Disclosure

| SEQ ID NO: | Type | Species | Description | Sequence |
|---|---|---|---|---|
| | | | | KGFYPSDIAVEWESNGQPENNYKTTPPVLDS DGSFFLYSKLTVDKSRWQQGNVFSCSVMHE ALHNHYTQKSLSLSPGKGGGGSGGGGSGGG GSGGGGSSMLPAPKNLVVSRVTEDSARLSWT APDAAFDSFHIEYAEPWVWGEAIVLTVPGSE RSYDLTGLKPGTEYVVFIGGVKGGHNSTPLS AIFTTGGGSGGGGSGGGGSGGGGSMLPAPK NLVVSRVTEDSARLSWTAPDAAFDSFWITYE EKFYRGEAIVLTVPGSERSYDLTGLKPGTEYK VWIVGVKGGQGSWPLSAIFTT |
| 892 | PRT | Human | ProteinA9HC118 | EVQLVQSGAEVKKPGESLKISCKGSGYSFTSY WIGWVRQMPGKGLEWMGIIYPGDSDTRYSP SFQGQVTISADKSISTAYLQWSSLKASDTAM YYCARWSYSQYSGWLDYWGQGTLVTVSSA STKGPSVFPLAPSSKSTSGGTAALGCLVKDYF PEPVTVSWNSGALTSGVHTFPAVLQSSGLYS LSSVVTVPSSSLGTQTYICNVNHKPSNTKVDK KVEPKSCDKTHTCPPCPAPPVAGPDVFLFPPK PKDTLMISRTPEVTCVVVDVSHEDPEVKFNW YVDGVEVHNAKTKPREEQYNSTYRVVSVLT VLHQDWLNGKEYKCKVSNAALPAPIAKTISK AKGQPREPQVYTLPPSRDELTKNQVSLTCLV KGFYPSDIAVEWESNGQPENNYKTTPPVLDS DGSFFLYSKLTVDKSRWQQGNVFSCSVMHE ALHNHYTQKSLSLSPGKGGGGSGGGGSGGG GSGGGGSLPAPKNLVVSRVTEDSARLSWTAP DAAFDSFHIEYAEPWVWGEAIVLTVPGSERS YDLTGLKPGTEYVVFIGGVKGGHNSTPLSAIF TTGGGGSGGGGSGGGGSGGGGSMLPAPKNL VVSRVTEDSARLSWTAPDAAFDSFWITYEEK FYRGEAIVLTVPGSERSYDLTGLKPGTEYKV WIVGVKGGQGSWPLSAIFTT |
| 893 | PRT | Human | CR-5133HC119 | EVQLVETGGGLVKPGGSLRLSCSASRFSFRD YYMTWIRQAPGKGPEWVSHISGSGSTIYYAD SVRGRFTISRDNAKSSLYLQMDSLQADDTAV YYCARGGRATSYYWHWGPGTLVTVSSAST KGPSVFPLAPSSKSTSGGTAALGCLVKDYFPE PVTVSWNSGALTSGVHTFPAVLQSSGLYSLS SVVTVPSSSLGTQTYICNVNHKPSNTKVDKK VEPKSCDKTHTCPPCPAPPVAGPDVFLFPPKP KDTLMISRTPEVTCVVVDVSHEDPEVKFNWY VDGVEVHNAKTKPREEQYNSTYRVVSVLTV LHQDWLNGKEYKCKVSNAALPAPIAKTISKA KGQPREPQVYTLPPSRDELTKNQVSLTCLVK GFYPSDIAVEWESNGQPENNYKTTPPVLDSD GSFFLYSKLTVDKSRWQQGNVFSCSVMHEA LHNRFTQKSLSLSPGGGGSGGGGSGGGGSG GGGSMLPAPKNLVVSRVTEDSARLSWTAPD AAFDSFHIEYAEPWVWGEAIVLTVPGSERSY DLTGLKPGTEYVVFIGGVKGGHNSTPLSAIFT TGGGGSGGGGSGGGGSGGGGSMLPAPKNLV VSRVTEDSARLSWTAPDAAFDSFWITYEEKF YRGEAIVLTVPGSERSYDLTGLKPGTEYKVW IVGVKGGQGSWPLSAIFTT |
| 894 | PRT | Human | CR-5133HC120 | EVQLVETGGGLVKPGGSLRLSCSASRFSFRD YYMTWIRQAPGKGPEWVSHISGSGSTIYYAD SVRGRFTISRDNAKSSLYLQMDSLQADDTAV YYCARGGRATSYYWHWGPGTLVTVSSAST KGPSVFPLAPSSKSTSGGTAALGCLVKDYFPE PVTVSWNSGALTSGVHTFPAVLQSSGLYSLS SVVTVPSSSLGTQTYICNVNHKPSNTKVDKK VEPKSCDKTHTCPPCPAPPVAGPDVFLFPPKP KDTLMISRTPEVTCVVVDVSHEDPEVKFNWY VDGVEVHNAKTKPREEQYNSTYRVVSVLTV LHQDWLNGKEYKCKVSNAALPAPIAKTISKA KGQPREPQVYTLPPSRDELTKNQVSLTCLVK GFYPSDIAVEWESNGQPENNYKTTPPVLDSD GSFFLYSKLTVDKSRWQQGNVFSCSVMHEA LHNHYTQKSLSLSPGGGGSGGGGSGGGGS GGGGSMLPAPKNLVVSRVTEDSARLSWTAP DAAFDSFHIEYAEPWVWGEAIVLTVPGSERS YDLTGLKPGTEYVVFIGGVKGGHNSTPLSAIF |

TABLE 6-continued

Nucleic Acid and Amino Acid Sequences of the Disclosure

| SEQ ID NO: | Type | Species | Description | Sequence |
|---|---|---|---|---|
| | | | | TTGGGGSGGGGSGGGGSGGGGSMLPAPKNL VVSRVTEDSARLSWTAPDAAFDSFWITYEEK FYRGEAIVLTVPGSERSYDLTGLKPGTEYKV WIVGVKGGQGSWPLSAIFTT |
| 895 | PRT | Human | RSVHC121 | QITLKESGPTLVKPTQTLTLTCTFSGFSLSTSG MGVSWIRQPPGKALEWLAHIYWDDDKRYNP SLKSRLTITKDTSKNQVVLTMTNMDPVDTAT YYCARLYGFTYGFAYWGQGTLVTVSSASTK GPSVFPLAPSSKSTSGGTAALGCLVKDYFPEP VTVSWNSGALTSGVHTFPAVLQSSGLYSLSS VVTVPSSSLGTQTYICNVNHKPSNTKVDKKV EPKSCDKTHTCPPCPAPPVAGPDVFLFPPKPK DTLMISRTPEVTCVVVDVSHEDPEVKFNWYV DGVEVHNAKTKPREEQYNSTYRVVSVLTVL HQDWLNGKEYKCKVSNAALPAPIAKTISKAK GQPREPQVYTLPPSRDELTKNQVSLTCLVKG FYPSDIAVEWESNGQPENNYKTTPPVLDSDG SFFLYSKLTVDKSRWQQGNVFSCSVMHEAL HNRFTQKSLSLSPGKGGGGSGGGGSGGGGSG GGGSMLPAPKNLVVSRVTEDSARLSWTAPD AAFDSFLIQYQESEKVGEAIVLTVPGSERSYD LTGLKPGTEYTVSIYGVKGGHRSNPLSAIFTT |
| 896 | PRT | Human | RSVHC122 | QITLKESGPTLVKPTQTLTLTCTFSGFSLSTSG MGVSWIRQPPGKALEWLAHIYWDDDKRYNP SLKSRLTITKDTSKNQVVLTMTNMDPVDTAT YYCARLYGFTYGFAYWGQGTLVTVSSASTK GPSVFPLAPSSKSTSGGTAALGCLVKDYFPEP VTVSWNSGALTSGVHTFPAVLQSSGLYSLSS VVTVPSSSLGTQTYICNVNHKPSNTKVDKKV EPKSCDKTHTCPPCPAPPVAGPDVFLFPPKPK DTLMISRTPEVTCVVVDVSHEDPEVKFNWYV DGVEVHNAKTKPREEQYNSTYRVVSVLTVL HQDWLNGKEYKCKVSNAALPAPIAKTISKAK GQPREPQVYTLPPSRDELTKNQVSLTCLVKG FYPSDIAVEWESNGQPENNYKTTPPVLDSDG SFFLYSKLTVDKSRWQQGNVFSCSVMHEAL HNRFTQKSLSLSPGKGGGGSGGGGSGGGGSG GGGSLPAPKNLVVSRVTEDSARLSWTAPDAA FDSFLIQYQESEKVGEAIVLTVPGSERSYDLT GLKPGTEYTVSIYGVKGGHRSNPLSAIFTTGG GGSGGGGSGGGGSGGGGSLPAPKNLVVSRV TEDSARLSWTAPDAAFDSFLIQYQESEKVGE AIVLTVPGSERSYDLTGLKPGTEYTVSIYGVK GGHRSNPLSAIFTT |
| 897 | PRT | Human | RSVHC123 | QITLKESGPTLVKPTQTLTLTCTFSGFSLSTSG MGVSWIRQPPGKALEWLAHIYWDDDKRYNP SLKSRLTITKDTSKNQVVLTMTNMDPVDTAT YYCARLYGFTYGFAYWGQGTLVTVSSASTK GPSVFPLAPSSKSTSGGTAALGCLVKDYFPEP VTVSWNSGALTSGVHTFPAVLQSSGLYSLSS VVTVPSSSLGTQTYICNVNHKPSNTKVDKKV EPKSCDKTHTCPPCPAPPVAGPDVFLFPPKPK DTLMISRTPEVTCVVVDVSHEDPEVKFNWYV DGVEVHNAKTKPREEQYNSTYRVVSVLTVL HQDWLNGKEYKCKVSNAALPAPIAKTISKAK GQPREPQVYTLPPSRDELTKNQVSLTCLVKG FYPSDIAVEWESNGQPENNYKTTPPVLDSDG SFFLYSKLTVDKSRWQQGNVFSCSVMHEAL HNRFTQKSLSLSPGKGGGGSGGGGSGGGGSG GGGSMLPAPKNLVVSRVTEDSARLSWTAPD AAFDSFLIQYQESEKVGEAIVLTVPGSERSYD LTGLKPGTEYTVSIYGVKGGHRSNPLSAIFTT GGGGSGGGGSGGGGSGGGGSMLPAPKNLVV SRVTEDSARLSWTAPDAAFDSFLIQYQESEK VGEAIVLTVPGSERSYDLTGLKPGTEYTVSIY GVKGGHRSNPLSAIFTT |
| 898 | PRT | Human | ProteinA3HC124 | QVQLVQSGAEVKKPGSSVKVSCKASGGTFSS YAISWVRQAPGQGLEWMGWISAINGNTNYA QKFQGRVTITADESTSTAYMELSSLRSEDTAV YYCARIWNFLLDYWGQGTLVTVSSASTKGPS VFPLAPSSKSTSGGTAALGCLVKDYFPEPVTV |

TABLE 6-continued

Nucleic Acid and Amino Acid Sequences of the Disclosure

| SEQ ID NO: | Type | Species | Description | Sequence |
|---|---|---|---|---|
| | | | | SWNSGALTSGVHTFPAVLQSSGLYSLSSVVT VPSSSLGTQTYICNVNHKPSNTKVDKKVEPK SCDKTHTCPPCPAPPVAGPDVFLFPPKPKDTL MISRTPEVTCVVVDVSHEDPEVKFNWYVDG VEVHNAKTKPREEQYNSTYRVVSVLTVLHQ DWLNGKEYKCKVSNAALPAPIAKTISKAKGQ PREPQVYTLPPSRDELTKNQVSLTCLVKGFYP SDIAVEWESNGQPENNYKTTPPVLDSDGSFFL YSKLTVDKSRWQQGNVFSCSVMHEALHNRF TQKSLSLSPGKGGGGSGGGGSGGGGSGGGG SMLPAPKNLVVSRVTEDSARLSWTAPDAAFD SFWITYEEKFYRGEAIVLTVPGSERSYDLTGL KPGTEYKVWIVGVKGGQGSWPLSAIFTT |
| 899 | PRT | Human | ProteinA9HC125 | EVQLVQSGAEVKKPGESLKISCKGSGYSFTSY WIGWVRQMPGKGLEWMGIIYPGDSDTRYSP SFQGQVTISADKSISTAYLQWSSLKASDTAM YYCARWSYSQYSGWLDYWGQGTLVTVSSA STKGPSVFPLAPSSKSTSGGTAALGCLVKDYF PEPVTVSWNSGALTSGVHTFPAVLQSSGLYS LSSVVTVPSSSLGTQTYICNVNHKPSNTKVDK KVEPKSCDKTHTCPPCPAPPVAGPDVFLFPPK PKDTLMISRTPEVTCVVVDVSHEDPEVKFNW YVDGVEVHNAKTKPREEQYNSTYRVVSVLT VLHQDWLNGKEYKCKVSNAALPAPIAKTISK AKGQPREPQVYTLPPSRDELTKNQVSLTCLV KGFYPSDIAVEWESNGQPENNYKTTPPVLDS DGSFFLYSKLTVDKSRWQQGNVFSCSVMHE ALHNRFTQKSLSLSPGKGGGGSGGGGSGGG GSGGGGSMLPAPKNLVVSRVTEDSARLSWT APDAAFDSFWITYEEKFYRGEAIVLTVPGSER SYDLTGLKPGTEYKVWIVGVKGGQGSWPLS AIFTT |
| 900 | PRT | Human | CR-5133HC126 | EVQLVETGGGLVKPGGSLRLSCSASRFSFRD YYMTWIRQAPGKGPEWVSHISGSGSTIYYAD SVRGRFTISRDNAKSSLYLQMDSLQADDTAV YYCARGGRATSYYWVHWGPGTLVTVSSAST KGPSVFPLAPSSKSTSGGTAALGCLVKDYFPE PVTVSWNSGALTSGVHTFPAVLQSSGLYSLS SVVTVPSSSLGTQTYICNVNHKPSNTKVDKK VEPKSCDKTHTCPPCPAPPVAGPDVFLFPPKP KDTLMISRTPEVTCVVVDVSHEDPEVKFNWY VDGVEVHNAKTKPREEQYNSTYRVVSVLTV LHQDWLNGKEYKCKVSNAALPAPIAKTISKA KGQPREPQVYTLPPSRDELTKNQVSLTCLVK GFYPSDIAVEWESNGQPENNYKTTPPVLDSD GSFFLYSKLTVDKSRWQQGNVFSCSVMHEA LHNRFTQKSLSLSPGKGGGGSGGGGSGGGS GGGGSMLPAPKNLVVSRVTEDSARLSWTAP DAAFDSFLIQYQESEKVGEAIVLTVPGSERSY DLTGLKPGTEYTVSIYGVELIYHGWLDFVFS NPLSAIFTT |
| 901 | PRT | Human | ProteinA3HC127 | QVQLVQSGAEVKKPGSSVKVSCKASGGTFSS YAISWVRQAPGQGLEWMGWISAINGNTNYA QKFQGRVTITADESTSTAYMELSSLRSEDTAV YYCARIWNFLLDYWGQGTLVTVSSASTKGPS VFPLAPSSKSTSGGTAALGCLVKDYFPEPVTV SWNSGALTSGVHTFPAVLQSSGLYSLSSVVT VPSSSLGTQTYICNVNHKPSNTKVDKKVEPK SCDKTHTCPPCPAPPVAGPDVFLFPPKPKDTL MISRTPEVTCVVVDVSHEDPEVKFNWYVDG VEVHNAKTKPREEQYNSTYRVVSVLTVLHQ DWLNGKEYKCKVSNAALPAPIAKTISKAKGQ PREPQVYTLPPSRDELTKNQVSLTCLVKGFYP SDIAVEWESNGQPENNYKTTPPVLDSDGSFFL YSKLTVDKSRWQQGNVFSCSVMHEALHNRF TQKSLSLSPGKGGGGSGGGGSGGGGSGGGG SMLPAPKNLVVSRVTEDSARLSWTAPDAAFD SFLIQYQESEKVGEAIVLTVPGSERSYDLTGL KPGTEYTVSIYGVELIYHGWLDFVFSNPLSAI FTT |

TABLE 6-continued

Nucleic Acid and Amino Acid Sequences of the Disclosure

| SEQ ID NO: | Type | Species | Description | Sequence |
|---|---|---|---|---|
| 902 | PRT | Human | ProteinA9HC128 | EVQLVQSGAEVKKPGESLKISCKGSGYSFTSY WIGWVRQMPGKGLEWMGIIYPGDSDTRYSP SFQGQVTISADKSISTAYLQWSSLKASDTAM YYCARWSYSQYSGWLDYWGQGTLVTVSSA STKGPSVFPLAPSSKSTSGGTAALGCLVKDYF PEPVTVSWNSGALTSGVHTFPAVLQSSGLYS LSSVVTVPSSSLGTQTYICNVNHKPSNTKVDK KVEPKSCDKTHTCPPCPAPPVAGPDVFLFPPK PKDTLMISRTPEVTCVVVDVSHEDPEVKFNW YVDGVEVHNAKTKPREEQYNSTYRVVSVLT VLHQDWLNGKEYKCKVSNAALPAPIAKTISK AKGQPREPQVYTLPPSRDELTKNQVSLTCLV KGFYPSDIAVEWESNGQPENNYKTTPPVLDS DGSFFLYSKLTVDKSRWQQGNVFSCSVMHE ALHNRFTQKSLSLSPGKGGGGSGGGGSGGG GSGGGGSMLPAPKNLVVSRVTEDSARLSWT APDAAFDSFLIQYQESEKVGEAIVLTVPGSER SYDLTGLKPGTEYTVSIYGVELIYHGWLDFV FSNPLSAIFTT |
| 903 | PRT | Human | CR-5133HC129 | EVQLVETGGGLVKPGGSLRLSCSASRFSFRD YYMTWIRQAPGKGPEWVSHISGSGSTIYYAD SVRGRFTISRDNAKSSLYLQMDSLQADDTAV YYCARGGRATSYYWVHWGPGTLVTVSSAST KGPSVFPLAPSSKSTSGGTAALGCLVKDYFPE PVTVSWNSGALTSGVHTFPAVLQSSGLYSLS SVVTVPSSSLGTQTYICNVNHKPSNTKVDKK VEPKSCDKTHTCPPCPAPPVAGPDVFLFPPKP KDTLMISRTPEVTCVVVDVSHEDPEVKFNWY VDGVEVHNAKTKPREEQYNSTYRVVSVLTV LHQDWLNGKEYKCKVSNAALPAPIAKTISKA KGQPREPQVYTLPPSRDELTKNQVSLTCLVK GFYPSDIAVEWESNGQPENNYKTTPPVLDSD GSFFLYSKLTVDKSRWQQGNVFSCSVMHEA LHNRFTQKSLSLSPGKGGGGSGGGGSGGGGS GGGGSLPAPKNLVVSRVTEDSARLSWTAPDA AFDSFLIQYQESEKVGEAIVLTVPGSERSYDL TGLKPGTEYTVSIYGVELIYHGWLDFVFSNPL SAIFTT |
| 904 | PRT | Human | ProteinA3HC130 | QVQLVQSGAEVKKPGSSVKVSCKASGGTFSS YAISWVRQAPGQGLEWMGWISAINGNTNYA QKFQGRVTITADESTSTAYMELSSLRSEDTAV YYCARIWNFLLDYWGQGTLVTVSSASTKGPS VFPLAPSSKSTSGGTAALGCLVKDYFPEPVTV SWNSGALTSGVHTFPAVLQSSGLYSLSSVVT VPSSSLGTQTYICNVNHKPSNTKVDKKVEPK SCDKTHTCPPCPAPPVAGPDVFLFPPKPKDTL MISRTPEVTCVVVDVSHEDPEVKFNWYVDG VEVHNAKTKPREEQYNSTYRVVSVLTVLHQ DWLNGKEYKCKVSNAALPAPIAKTISKAKGQ PREPQVYTLPPSRDELTKNQVSLTCLVKGFYP SDIAVEWESNGQPENNYKTTPPVLDSDGSFFL YSKLTVDKSRWQQGNVFSCSVMHEALHNRF TQKSLSLSPGKGGGGSGGGGSGGGGSGGGG SLPAPKNLVVSRVTEDSARLSWTAPDAAFDS FLIQYQESEKVGEAIVLTVPGSERSYDLTGLK PGTEYTVSIYGVELIYHGWLDFVFSNPLSAIFTT |
| 905 | PRT | Human | ProteinA9HC131 | EVQLVQSGAEVKKPGESLKISCKGSGYSFTSY WIGWVRQMPGKGLEWMGIIYPGDSDTRYSP SFQGQVTISADKSISTAYLQWSSLKASDTAM YYCARWSYSQYSGWLDYWGQGTLVTVSSA STKGPSVFPLAPSSKSTSGGTAALGCLVKDYF PEPVTVSWNSGALTSGVHTFPAVLQSSGLYS LSSVVTVPSSSLGTQTYICNVNHKPSNTKVDK KVEPKSCDKTHTCPPCPAPPVAGPDVFLFPPK PKDTLMISRTPEVTCVVVDVSHEDPEVKFNW YVDGVEVHNAKTKPREEQYNSTYRVVSVLT VLHQDWLNGKEYKCKVSNAALPAPIAKTISK AKGQPREPQVYTLPPSRDELTKNQVSLTCLV KGFYPSDIAVEWESNGQPENNYKTTPPVLDS DGSFFLYSKLTVDKSRWQQGNVFSCSVMHE ALHNRFTQKSLSLSPGKGGGGSGGGGSGGG |

TABLE 6-continued

Nucleic Acid and Amino Acid Sequences of the Disclosure

| SEQ ID NO: | Type | Species | Description | Sequence |
|---|---|---|---|---|
| | | | | GSGGGGSLPAPKNLVVSRVTEDSARLSWTAP DAAFDSFLIQYQESEKVGEAIVLTVPGSERSY DLTGLKPGTEYTVSIYGVELIYHGWLDFVFS NPLSAIFTT |
| 906 | PRT | Human | CR-5133HC132 | EVQLVETGGGLVKPGGSLRLSCSASRFSFRD YYMTWIRQAPGKGPEWVSHISGSGSTIYYAD SVRGRFTISRDNAKSSLYLQMDSLQADDTAV YYCARGGRATSYYWVHWGPGTLVTVSSAST KGPSVFPLAPSSKSTSGGTAALGCLVKDYFPE PVTVSWNSGALTSGVHTFPAVLQSSGLYSLS SVVTVPSSSLGTQTYICNVNHKPSNTKVDKK VEPKSCDKTHTCPPCPAPPVAGPDVFLFPPKP KDTLMISRTPEVTCVVVDVSHEDPEVKFNWY VDGVEVHNAKTKPREEQYNSTYRVVSVLTV LHQDWLNGKEYKCKVSNAALPAPIAKTISKA KGQPREPQVYTLPPSRDELTKNQVSLTCLVK GFYPSDIAVEWESNGQPENNYKTTPPVLDSD GSFFLYSKLTVDKSRWQQGNVFSCSVMHEA LHNRFTQKSLSLSPGKGGGGSGGGGSGGGGS GGGGSMLPAPKNLVVSRVTEDSARLSWTAP DAAFDSFWITYEEKFYRGEAIVLTVPGSERSY DLTGLKPGTEYKVWIVGVKGGQGSWPLSAIF TTGGGGSGGGGSGGGGSGGGGSMLPAPKNL VVSRVTEDSARLSWTAPDAAFDSFLIQYQES EKVGEAIVLTVPGSERSYDLTGLKPGTEYTVS IYGVELIYHGWLDFVFSNPLSAIFTT |
| 907 | PRT | Human | CR-5133HC133 | EVQLVETGGGLVKPGGSLRLSCSASRFSFRD YYMTWIRQAPGKGPEWVSHISGSGSTIYYAD SVRGRFTISRDNAKSSLYLQMDSLQADDTAV YYCARGGRATSYYWVHWGPGTLVTVSSAST KGPSVFPLAPSSKSTSGGTAALGCLVKDYFPE PVTVSWNSGALTSGVHTFPAVLQSSGLYSLS SVVTVPSSSLGTQTYICNVNHKPSNTKVDKK VEPKSCDKTHTCPPCPAPPVAGPDVFLFPPKP KDTLMISRTPEVTCVVVDVSHEDPEVKFNWY VDGVEVHNAKTKPREEQYNSTYRVVSVLTV LHQDWLNGKEYKCKVSNAALPAPIAKTISKA KGQPREPQVYTLPPSRDELTKNQVSLTCLVK GFYPSDIAVEWESNGQPENNYKTTPPVLDSD GSFFLYSKLTVDKSRWQQGNVFSCSVMHEA LHNRFTQKSLSLSPGKGGGGSGGGGSGGGGS GGGGSMLPAPKNLVVSRVTEDSARLSWTAP DAAFDSFWITYEEKFYRGEAIVLTVPGSERSY DLTGLKPGTEYKVWIVGVKGGQGSWPLSAIF TTGGGGSGGGGSGGGGSGGGGSLPAPKNLV VSRVTEDSARLSWTAPDAAFDSFLIQYQESE KVGEAIVLTVPGSERSYDLTGLKPGTEYTVSI YGVELIYHGWLDFVFSNPLSAIFTT |
| 908 | PRT | Human | ProteinA3HC134 | QVQLVQSGAEVKKPGSSVKVSCKASGGTFSS YAISWVRQAPGQGLEWMGWISAINGNTNYA QKFQGRVTITADESTSTAYMELSSLRSEDTAV YYCARIWNFLLDYWGQGTLVTVSSASTKGPS VFPLAPSSKSTSGGTAALGCLVKDYFPEPVTV SWNSGALTSGVHTFPAVLQSSGLYSLSSVVT VPSSSLGTQTYICNVNHKPSNTKVDKKVEPK SCDKTHTCPPCPAPPVAGPDVFLFPPKPKDTL MISRTPEVTCVVVDVSHEDPEVKFNWYVDG VEVHNAKTKPREEQYNSTYRVVSVLTVLHQ DWLNGKEYKCKVSNAALPAPIAKTISKAGQ PREPQVYTLPPSRDELTKNQVSLTCLVKGFYP SDIAVEWESNGQPENNYKTTPPVLDSDGSFFL YSKLTVDKSRWQQGNVFSCSVMHEALHNRF TQKSLSLSPGKGGGGSGGGGSGGGGSGGGG SMLPAPKNLVVSRVTEDSARLSWTAPDAAFD SFWITYEEKFYRGEAIVLTVPGSERSYDLTGL KPGTEYKVWIVGVKGGQGSWPLSAIFTTGGG GSGGGGSGGGGSGGGGSMLPAPKNLVVSRV TEDSARLSWTAPDAAFDSFLIQYQESEKVGE AIVLTVPGSERSYDLTGLKPGTEYTVSIYGVE LIYHGWLDFVFSNPLSAIFTT |

TABLE 6-continued

Nucleic Acid and Amino Acid Sequences of the Disclosure

| SEQ ID NO: | Type | Species | Description | Sequence |
|---|---|---|---|---|
| 909 | PRT | Human | ProteinA3HC135 | QVQLVQSGAEVKKPGSSVKVSCKASGGTFSS YAISWVRQAPGQGLEWMGWISAINGNTNYA QKFQGRVTITADESTSTAYMELSSLRSEDTAV YYCARIWNFLLDYWGQGTLVTVSSASTKGPS VFPLAPSSKSTSGGTAALGCLVKDYFPEPVTV SWNSGALTSGVHTFPAVLQSSGLYSLSSVVT VPSSSLGTQTYICNVNHKPSNTKVDKKVEPK SCDKTHTCPPCPAPPVAGPDVFLFPPKPKDTL MISRTPEVTCVVVDVSHEDPEVKFNWYVDG VEVHNAKTKPREEQYNSTYRVVSVLTVLHQ DWLNGKEYKCKVSNAALPAPIAKTISKAKGQ PREPQVYTLPPSRDELTKNQVSLTCLVKGFYP SDIAVEWESNGQPENNYKTTPPVLDSDGSFFL YSKLTVDKSRWQQGNVFSCSVMHEALHNRF TQKSLSLSPGKGGGGSGGGGSGGGGSGGGG SMLPAPKNLVVSRVTEDSARLSWTAPDAAFD SFWITYEEKFYRGEAIVLTVPGSERSYDLTGL KPGTEYKVWIVGVKGGQGSWPLSAIFTTGGG GSGGGGSGGGGSGGGGSLPAPKNLVVSRVT EDSARLSWTAPDAAFDSFLIQYQESEKVGEAI VLTVPGSERSYDLTGLKPGTEYTVSIYGVELI YHGWLDFVFSNPLSAIFTT |
| 910 | PRT | Human | ProteinA9HC136 | EVQLVQSGAEVKKPGESLKISCKGSGYSFTSY WIGWVRQMPGKGLEWMGIIYPGDSDTRYSP SFQGQVTISADKSISTAYLQWSSLKASDTAM YYCARWSYSQYSGWLDYWGQGTLVTVSSA STKGPSVFPLAPSSKSTSGGTAALGCLVKDYF PEPVTVSWNSGALTSGVHTFPAVLQSSGLYS LSSVVTVPSSSLGTQTYICNVNHKPSNTKVDK KVEPKSCDKTHTCPPCPAPPVAGPDVFLFPPK PKDTLMISRTPEVTCVVVDVSHEDPEVKFNW YVDGVEVHNAKTKPREEQYNSTYRVVSVLT VLHQDWLNGKEYKCKVSNAALPAPIAKTISK AKGQPREPQVYTLPPSRDELTKNQVSLTCLV KGFYPSDIAVEWESNGQPENNYKTTPPVLDS DGSFFLYSKLTVDKSRWQQGNVFSCSVMHE ALHNRFTQKSLSLSPGKGGGGSGGGGSGGG GSGGGGSMLPAPKNLVVSRVTEDSARLSWT APDAAFDSFWITYEEKFYRGEAIVLTVPGSER SYDLTGLKPGTEYKVWIVGVKGGQGSWPLS AIFTTGGGGSGGGGSGGGGSGGGGSMLPAPK NLVVSRVTEDSARLSWTAPDAAFDSFLIQYQ ESEKVGEAIVLTVPGSERSYDLTGLKPGTEYT VSIYGVELIYHGWLDFVFSNPLSAIFTT |
| 911 | PRT | Human | ProteinA9HC137 | EVQLVQSGAEVKKPGESLKISCKGSGYSFTSY WIGWVRQMPGKGLEWMGIIYPGDSDTRYSP SFQGQVTISADKSISTAYLQWSSLKASDTAM YYCARWSYSQYSGWLDYWGQGTLVTVSSA STKGPSVFPLAPSSKSTSGGTAALGCLVKDYF PEPVTVSWNSGALTSGVHTFPAVLQSSGLYS LSSVVTVPSSSLGTQTYICNVNHKPSNTKVDK KVEPKSCDKTHTCPPCPAPPVAGPDVFLFPPK PKDTLMISRTPEVTCVVVDVSHEDPEVKFNW YVDGVEVHNAKTKPREEQYNSTYRVVSVLT VLHQDWLNGKEYKCKVSNAALPAPIAKTISK AKGQPREPQVYTLPPSRDELTKNQVSLTCLV KGFYPSDIAVEWESNGQPENNYKTTPPVLDS DGSFFLYSKLTVDKSRWQQGNVFSCSVMHE ALHNRFTQKSLSLSPGKGGGGSGGGGSGGG GSGGGGSMLPAPKNLVVSRVTEDSARLSWT APDAAFDSFWITYEEKFYRGEAIVLTVPGSER SYDLTGLKPGTEYKVWIVGVKGGQGSWPLS AIFTTGGGSGGGGSGGGGSGGGGSLPAPKN LVVSRVTEDSARLSWTAPDAAFDSFLIQYQE SEKVGEAIVLTVPGSERSYDLTGLKPGTEYTV SIYGVELIYHGWLDFVFSNPLSAIFTT |
| 912 | PRT | Human | CR-5133HC138 | EVQLVETGGGLVKPGGSLRLSCSASRFSFRD YYMTWIRQAPGKGPEWVSHISGSGSTIYYAD SVRGRFTISRDNAKSSLYLQMDSLQADDTAV YYCARGGRATSYYWHWGPGTLVTVSSAST KGPSVFPLAPSSKSTSGGTAALGCLVKDYFPE |

TABLE 6-continued

Nucleic Acid and Amino Acid Sequences of the Disclosure

| SEQ ID NO: | Type | Species | Description | Sequence |
|---|---|---|---|---|
| | | | | PVTVSWNSGALTSGVHTFPAVLQSSGLYSLS SVVTVPSSSLGTQTYICNVNHKPSNTKVDKK VEPKSCDKTHTCPPCPAPPVAGPDVFLFPPKP KDTLMISRTPEVTCVVVDVSHEDPEVKFNWY VDGVEVHNAKTKPREEQYNSTYRVVSVLTV LHQDWLNGKEYKCKVSNAALPAPIAKTISKA KGQPREPQVYTLPPSRDELTKNQVSLTCLVK GFYPSDIAVEWESNGQPENNYKTTPPVLDSD GSFFLYSKLTVDKSRWQQGNVFSCSVMHEA LHNRFTQKSLSLSPGKGGGGSGGGGSGGGGS GGGGSMLPAPKNLVVSRVTEDSARLSWTAP DAAFDSFLIQYQESEKVGEAIVLTVPGSERSY DLTGLKPGTEYTVSIYGVELIYHGWLDFVFS NPLSAIFTTGGGGSGGGGSGGGGSGGGGSML PAPKNLVVSRVTEDSARLSWTAPDAAFDSFW ITYEEKFYRGEAIVLTVPGSERSYDLTGLKPG TEYKVWIVGVKGGQGSWPLSAIFTT |
| 913 | PRT | Human | CR-5133HC139 | EVQLVETGGGLVKPGGSLRLSCSASRFSFRD YYMTWIRQAPGKGPEWVSHISGSGSTIYYAD SVRGRFTISRDNAKSSLYLQMDSLQADDTAV YYCARGGRATSYYWHWGPGTLVTVSSAST KGPSVFPLAPSSKSTSGGTAALGCLVKDYFPE PVTVSWNSGALTSGVHTFPAVLQSSGLYSLS SVVTVPSSSLGTQTYICNVNHKPSNTKVDKK VEPKSCDKTHTCPPCPAPPVAGPDVFLFPPKP KDTLMISRTPEVTCVVVDVSHEDPEVKFNWY VDGVEVHNAKTKPREEQYNSTYRVVSVLTV LHQDWLNGKEYKCKVSNAALPAPIAKTISKA KGQPREPQVYTLPPSRDELTKNQVSLTCLVK GFYPSDIAVEWESNGQPENNYKTTPPVLDSD GSFFLYSKLTVDKSRWQQGNVFSCSVMHEA LHNRFTQKSLSLSPGKGGGGSGGGGSGGGGS GGGGSLPAPKNLVVSRVTEDSARLSWTAPDA AFDSFLIQYQESEKVGEAIVLTVPGSERSYDL TGLKPGTEYTVSIYGVELIYHGWLDFVFSNPL SAIFTTGGGGSGGGGSGGGGSGGGGSMLPAP KNLVVSRVTEDSARLSWTAPDAAFDSFWITY EEKFYRGEAIVLTVPGSERSYDLTGLKPGTEY KVWIVGVKGGQGSWPLSAIFTT |
| 914 | PRT | Human | ProteinA3HC140 | QVQLVQSGAEVKKPGSSVKVSCKASGGTFSS YAISWVRQAPGQGLEWMGWISAINGNTNYA QKFQGRVTITADESTSTAYMELSSLRSEDTAV YYCARIWNFLLDYWGQGTLVTVSSASTKGPS VFPLAPSSKSTSGGTAALGCLVKDYFPEPVTV SWNSGALTSGVHTFPAVLQSSGLYSLSSVVT VPSSSLGTQTYICNVNHKPSNTKVDKKVEPK SCDKTHTCPPCPAPPVAGPDVFLFPPKPKDTL MISRTPEVTCVVVDVSHEDPEVKFNWYVDG VEVHNAKTKPREEQYNSTYRVVSVLTVLHQ DWLNGKEYKCKVSNAALPAPIAKTISKAKGQ PREPQVYTLPPSRDELTKNQVSLTCLVKGFYP SDIAVEWESNGQPENNYKTTPPVLDSDGSFFL YSKLTVDKSRWQQGNVFSCSVMHEALHNRF TQKSLSLSPGKGGGGSGGGGSGGGGSGGGG SMLPAPKNLVVSRVTEDSARLSWTAPDAAFD SFLIQYQESEKVGEAIVLTVPGSERSYDLTGL KPGTEYTVSIYGVELIYHGWLDFVFSNPLSAI FTTGGGGSGGGGSGGGGSGGGGSMLPAPKN LVVSRVTEDSARLSWTAPDAAFDSFWITYEE KFYRGEAIVLTVPGSERSYDLTGLKPGTEYK VWIVGVKGGQGSWPLSAIFTT |
| 915 | PRT | Human | ProteinA3HC141 | QVQLVQSGAEVKKPGSSVKVSCKASGGTFSS YAISWVRQAPGQGLEWMGWISAINGNTNYA QKFQGRVTITADESTSTAYMELSSLRSEDTAV YYCARIWNFLLDYWGQGTLVTVSSASTKGPS VFPLAPSSKSTSGGTAALGCLVKDYFPEPVTV SWNSGALTSGVHTFPAVLQSSGLYSLSSVVT VPSSSLGTQTYICNVNHKPSNTKVDKKVEPK SCDKTHTCPPCPAPPVAGPDVFLFPPKPKDTL MISRTPEVTCVVVDVSHEDPEVKFNWYVDG VEVHNAKTKPREEQYNSTYRVVSVLTVLHQ DWLNGKEYKCKVSNAALPAPIAKTISKAKGQ |

TABLE 6-continued

Nucleic Acid and Amino Acid Sequences of the Disclosure

| SEQ ID NO: | Type | Species | Description | Sequence |
|---|---|---|---|---|
| | | | | PREPQVYTLPPSRDELTKNQVSLTCLVKGFYP SDIAVEWESNGQPENNYKTTPPVLDSDGSFFL YSKLTVDKSRWQQGNVFSCSVMHEALHNRF TQKSLSLSPGKGGGGSGGGGSGGGGSGGGG SLPAPKNLVVSRVTEDSARLSWTAPDAAFDS FLIQYQESEKVGEAIVLTVPGSERSYDLTGLK PGTEYTVSIYGVELIYHGWLDFVSNPLSAIFT TGGGGSGGGGSGGGGSGGGGSMLPAPKNLV VSRVTEDSARLSWTAPDAAFDSFWITYEEKF YRGEAIVLTVPGSERSYDLTGLKPGTEYKVW IVGVKGGQGSWPLSAIFTT |
| 916 | PRT | Human | ProteinA9HC142 | EVQLVQSGAEVKKPGESLKISCKGSGYSFTSY WIGWVRQMPGKGLEWMGIIYPGDSDTRYSP SFQGQVTISADKSISTAYLQWSSLKASDTAM YYCARWSYSQYSGWLDYWGQGTLVTVSSA STKGPSVFPLAPSSKSTSGGTAALGCLVKDYF PEPVTVSWNSGALTSGVHTFPAVLQSSGLYS LSSVVTVPSSSLGTQTYICNVNHKPSNTKVDK KVEPKSCDKTHTCPPCPAPPVAGPDVFLFPPK PKDTLMISRTPEVTCVVVDVSHEDPEVKFNW YVDGVEVHNAKTKPREEQYNSTYRVVSVLT VLHQDWLNGKEYKCKVSNAALPAPIAKTISK AKGQPREPQVYTLPPSRDELTKNQVSLTCLV KGFYPSDIAVEWESNGQPENNYKTTPPVLDS DGSFFLYSKLTVDKSRWQQGNVFSCSVMHE ALHNRFTQKSLSLSPGKGGGGSGGGGSGGG GSGGGGSMLPAPKNLVVSRVTEDSARLSWT APDAAFDSFLIQYQESEKVGEAIVLTVPGSER SYDLTGLKPGTEYTVSIYGVELIYHGWLDFV FSNPLSAIFTTGGGGSGGGGSGGGGSGGGGS MLPAPKNLVVSRVTEDSARLSWTAPDAAFDS FWITYEEKFYRGEAIVLTVPGSERSYDLTGLK PGTEYKVWIVGVKGGQGSWPLSAIFTT |
| 917 | PRT | Human | ProteinA9HC143 | EVQLVQSGAEVKKPGESLKISCKGSGYSFTSY WIGWVRQMPGKGLEWMGIIYPGDSDTRYSP SFQGQVTISADKSISTAYLQWSSLKASDTAM YYCARWSYSQYSGWLDYWGQGTLVTVSSA STKGPSVFPLAPSSKSTSGGTAALGCLVKDYF PEPVTVSWNSGALTSGVHTFPAVLQSSGLYS LSSVVTVPSSSLGTQTYICNVNHKPSNTKVDK KVEPKSCDKTHTCPPCPAPPVAGPDVFLFPPK PKDTLMISRTPEVTCVVVDVSHEDPEVKFNW YVDGVEVHNAKTKPREEQYNSTYRVVSVLT VLHQDWLNGKEYKCKVSNAALPAPIAKTISK AKGQPREPQVYTLPPSRDELTKNQVSLTCLV KGFYPSDIAVEWESNGQPENNYKTTPPVLDS DGSFFLYSKLTVDKSRWQQGNVFSCSVMHE ALHNRFTQKSLSLSPGKGGGGSGGGGSGGG GSGGGGSLPAPKNLVVSRVTEDSARLSWTAP DAAFDSFLIQYQESEKVGEAIVLTVPGSERSY DLTGLKPGTEYTVSIYGVELIYHGWLDFVFS NPLSAIFTTGGGGSGGGGSGGGGSGGGGSML PAPKNLVVSRVTEDSARLSWTAPDAAFDSFW ITYEEKFYRGEAIVLTVPGSERSYDLTGLKPG TEYKVWIVGVKGGQGSWPLSAIFTT |
| 918 | PRT | Human | CR-5133HC144 | EVQLVETGGGLVKPGGSLRLSCSASRFSFRD YYMTWIRQAPGKGPEWVSHISGSGSTIYYAD SVRGRFTISRDNAKSSLYLQMDSLQADDTAV YYCARGGRATSYYWVHWGPGTLVTVSSAST KGPSVFPLAPSSKSTSGGTAALGCLVKDYFPE PVTVSWNSGALTSGVHTFPAVLQSSGLYSLS SVVTVPSSSLGTQTYICNVNHKPSNTKVDKK VEPKSCDKTHTCPPCPAPPVAGPDVFLFPPKP KDTLMISRTPEVTCVVVDVSHEDPEVKFNWY VDGVEVHNAKTKPREEQYNSTYRVVSVLTV LHQDWLNGKEYKCKVSNAALPAPIAKTISKA KGQPREPQVYTLPPSRDELTKNQVSLTCLVK GFYPSDIAVEWESNGQPENNYKTTPPVLDSD GSFFLYSKLTVDKSRWQQGNVFSCSVMHEA LHNRFTQKSLSLSPGKGGGGSGGGGSGGGGS GGGGSMLPAPKNLVVSRVTEDSARLSWTAP DAAFDSFHIEYAEPWVWGEAIVLTVPGSERS |

TABLE 6-continued

Nucleic Acid and Amino Acid Sequences of the Disclosure

| SEQ ID NO: | Type | Species | Description | Sequence |
|---|---|---|---|---|
| | | | | YDLTGLKPGTEYVVFIGGVKGGHNSTPLSAIF TTGGGGSGGGGSGGGGSGGGGSMLPAPKNL VVSRVTEDSARLSWTAPDAAFDSFWITYEEK FYRGEAIVLTVPGSERSYDLTGLKPGTEYKV WIVGVKGGQGSWPLSAIFTTDYKDDDDK |
| 919 | PRT | Human | CR-5133HC145 | EQKLISEEDLEVQLVETGGGLVKPGGSLRLSC SASRFSFRDYYMTWIRQAPGKGPEWVSHISG SGSTIYYADSVRGRFTISRDNAKSSLYLQMDS LQADDTAVYYCARGGRATSYYWVHWGPGT LVTVSSASTKGPSVFPLAPSSKSTSGGTAALG CLVKDYFPEPVTVSWNSGALTSGVHTFPAVL QSSGLYSLSSVVTVPSSSLGTQTYICNVNHKP SNTKVDKKVEPKSCDKTHTCPPCPAPPVAGP DVFLFPPKPKDTLMISRTPEVTCVVVDVSHED PEVKFNWYVDGVEVHNAKTKPREEQYNSTY RVVSVLTVLHQDWLNGKEYKCKVSNAALPA PIAKTISKAKGQPREPQVYTLPPSRDELTKNQ VSLTCLVKGFYPSDIAVEWESNGQPENNYKT TPPVLDSDGSFFLYSKLTVDKSRWQQGNVFS CSVMHEALHNRFTQKSLSLSPGKGGGGSGG GGSGGGGSGGGGSMLPAPKNLVVSRVTEDS ARLSWTAPDAAFDSFHIEYAEPWVWGEAIVL TVPGSERSYDLTGLKPGTEYVVFIGGVKGGH NSTPLSAIFTTGGGGSGGGGSGGGGSGGGGS MLPAPKNLVVSRVTEDSARLSWTAPDAAFDS FWITYEEKFYRGEAIVLTVPGSERSYDLTGLK PGTEYKVWIVGVKGGQGSWPLSAIFTT |
| 920 | PRT | Human | CR-5133HC146 | EQKLISEEDLEVQLVETGGGLVKPGGSLRLSC SASRFSFRDYYMTWIRQAPGKGPEWVSHISG SGSTIYYADSVRGRFTISRDNAKSSLYLQMDS LQADDTAVYYCARGGRATSYYWVHWGPGT LVTVSSASTKGPSVFPLAPSSKSTSGGTAALG CLVKDYFPEPVTVSWNSGALTSGVHTFPAVL QSSGLYSLSSVVTVPSSSLGTQTYICNVNHKP SNTKVDKKVEPKSCDKTHTCPPCPAPPVAGP DVFLFPPKPKDTLMISRTPEVTCVVVDVSHED PEVKFNWYVDGVEVHNAKTKPREEQYNSTY RVVSVLTVLHQDWLNGKEYKCKVSNAALPA PIAKTISKAKGQPREPQVYTLPPSRDELTKNQ VSLTCLVKGFYPSDIAVEWESNGQPENNYKT TPPVLDSDGSFFLYSKLTVDKSRWQQGNVFS CSVMHEALHNRFTQKSLSLSPGKGGGGSGG GGSGGGGSGGGGSMLPAPKNLVVSRVTEDS ARLSWTAPDAAFDSFHIEYAEPWVWGEAIVL TVPGSERSYDLTGLKPGTEYVVFIGGVKGGH NSTPLSAIFTTGGGGSGGGGSGGGGSGGGGS MLPAPKNLVVSRVTEDSARLSWTAPDAAFDS FWITYEEKFYRGEAIVLTVPGSERSYDLTGLK PGTEYKVWIVGVKGGQGSWPLSAIFTTDYKD DDDK |
| 921 | PRT | Human | CSD7HC151 | QVQLQESGPGLVKPSETLSLTCTVSGGSIRSSS YYWGWFRQTPGKGLEWLGNVFFSGSAYYNP SLKNRVTISIDTSENQSSLKLTSVTAADTAVY YCARPQAYSHDSSGHSPFDLWGRGTLVTVSS ASTKGPSVFPLAPSSKSTSGGTAALGCLVKD YFPEPVTVSWNSGALTSGVHTFPAVLQSSGL YSLSSVVTVPSSSLGTQTYICNVNHKPSNTKV DKKVEPKSCDKTHTCPPCPAPPVAGPDVFLFP PKPKDTLMISRTPEVTCVVVDVSHEDPEVKF NWYVDGVEVHNAKTKPREEQYNSTYRVVS VLTVLHQDWLNGKEYKCKVSNAALPAPIAK TISKAKGQPREPQVYTLPPSRDELTKNQVSLT CLVKGFYPSDIAVEWESNGQPENNYKTTPPV LDSDGSFFLYSKLTVDKSRWQQGNVFSCSV MHEALHNRFTQKSLSLSPGKGGGGSGGGGS GGGGSGGGGSMLPAPKNLVVSRVTEDSARL SWTAPDAAFDSFHIEYAEPWVWGEAIVLTVP GSERSYDLTGLKPGTEYVVFIGGVKGGHNST PLSAIFTTGGGGSGGGGSGGGGSGGGGSMLP APKNLVVSRVTEDSARLSWTAPDAAFDSFWI TYEEKFYRGEAIVLTVPGSERSYDLTGLKPGT EYKVWIVGVKGGQGSWPLSAIFTT |

TABLE 6-continued

Nucleic Acid and Amino Acid Sequences of the Disclosure

| SEQ ID NO: | Type | Species | Description | Sequence |
|---|---|---|---|---|
| 922 | PRT | Human | CSD7HC152 | QVQLQESGPGLVKPSETLSLTCTVSGGSIRSSS YYWGWFRQTPGKGLEWLGNVFFSGSAYYNP SLKNRVTISIDTSENQSSLKLTSVTAADTAVY YCARPQAYSHDSSGHSPFDLWGRGTLVTVSS ASTKGPSVFPLAPSSKSTSGGTAALGCLVKD YFPEPVTVSWNSGALTSGVHTFPAVLQSSGL YSLSSVVTVPSSSLGTQTYICNVNHKPSNTKV DKKVEPKSCDKTHTCPPCPAPPVAGPDVFLFP PKPKDTLMISRTPEVTCVVVDVSHEDPEVKF NWYVDGVEVHNAKTKPREEQYNSTYRVVS VLTVLHQDWLNGKEYKCKVSNAALPAPIAK TISKAKGQPREPQVYTLPPSRDELTKNQVSLT CLVKGFYPSDIAVEWESNGQPENNYKTTPPV LDSDGSFFLYSKLTVDKSRWQQGNVFSCSV MHEALHNHYTQKSLSLSPGKGGGGSGGGGS GGGGSGGGGSMLPAPKNLVVSRVTEDSARL SWTAPDAAFDSFHIEYAEPWVWGEAIVLTVP GSERSYDLTGLKPGTEYVVFIGGVKGGHNST PLSAIFTTGGGGSGGGGSGGGGSGGGGSMLP APKNLVVSRVTEDSARLSWTAPDAAFDSFWI TYEEKFYRGEAIVLTVPGSERSYDLTGLKPGT EYKVWIVGVKGGQGSWPLSAIFTT |
| 923 | PRT | Human | CR-6526HC153 | QVQLQESGGGVVQPGRSLRLSCAASGFTFSS YGMHWVRQAPGKGLEWVAVISYDGSNKYY ADSVKGRFTISRDNSKNTLYLQMNSLRAEDT AVYYCAKNGANAFDIWGQGTMVTVSSASTK GPSVFPLAPSSKSTSGGTAALGCLVKDYFPEP VTVSWNSGALTSGVHTFPAVLQSSGLYSLSS VVTVPSSSLGTQTYICNVNHKPSNTKVDKKV EPKSCDKTHTCPPCPAPPVAGPDVFLFPPKPK DTLMISRTPEVTCVVVDVSHEDPEVKFNWYV DGVEVHNAKTKPREEQYNSTYRVVSVLTVL HQDWLNGKEYKCKVSNAALPAPIAKTISKAK GQPREPQVYTLPPSRDELTKNQVSLTCLVKG FYPSDIAVEWESNGQPENNYKTTPPVLDSDG SFFLYSKLTVDKSRWQQGNVFSCSVMHEAL HNRFTQKSLSLSPGKGGGGSGGGGSGGGGSG GGGSMLPAPKNLVVSRVTEDSARLSWTAPD AAFDSFHIEYAEPWVWGEAIVLTVPGSERSY DLTGLKPGTEYVVFIGGVKGGHNSTPLSAIFT TGGGGSGGGGSGGGGSGGGGSMLPAPKNLV VSRVTEDSARLSWTAPDAAFDSFWITYEEKF YRGEAIVLTVPGSERSYDLTGLKPGTEYKVW IVGVKGGQGSWPLSAIFTT |
| 924 | PRT | Human | CR-6526HC154 | QVQLQESGGGVVQPGRSLRLSCAASGFTFSS YGMHWVRQAPGKGLEWVAVISYDGSNKYY ADSVKGRFTISRDNSKNTLYLQMNSLRAEDT AVYYCAKNGANAFDIWGQGTMVTVSSASTK GPSVFPLAPSSKSTSGGTAALGCLVKDYFPEP VTVSWNSGALTSGVHTFPAVLQSSGLYSLSS VVTVPSSSLGTQTYICNVNHKPSNTKVDKKV EPKSCDKTHTCPPCPAPPVAGPDVFLFPPKPK DTLMISRTPEVTCVVVDVSHEDPEVKFNWYV DGVEVHNAKTKPREEQYNSTYRVVSVLTVL HQDWLNGKEYKCKVSNAALPAPIAKTISKAK GQPREPQVYTLPPSRDELTKNQVSLTCLVKG FYPSDIAVEWESNGQPENNYKTTPPVLDSDG SFFLYSKLTVDKSRWQQGNVFSCSVMHEAL HNHYTQKSLSLSPGKGGGGSGGGGSGGGGS GGGGSMLPAPKNLVVSRVTEDSARLSWTAP DAAFDSFHIEYAEPWVWGEAIVLTVPGSERS YDLTGLKPGTEYVVFIGGVKGGHNSTPLSAIF TTGGGGSGGGGSGGGGSGGGGSMLPAPKNL VVSRVTEDSARLSWTAPDAAFDSFWITYEEK FYRGEAIVLTVPGSERSYDLTGLKPGTEYKV WIVGVKGGQGSWPLSAIFTT |
| 925 | PRT | Human | PagibaximabHC155 | EVMLVESGGGLVQPGKSLKLSCAASGFTFNN YAMNWVRQAPGKGLEWVARIRSKSNNYAT FYADSVKDRFTISRDDSQSMLYLQMNNLKTE DTAMYYCVRRGASGIDYAMDYWGQGTSLT VSSASTKGPSVFPLAPSSKSTSGGTAALGCLV |

TABLE 6-continued

Nucleic Acid and Amino Acid Sequences of the Disclosure

| SEQ ID NO: | Type | Species | Description | Sequence |
|---|---|---|---|---|
| | | | | KDYFPEPVTVSWNSGALTSGVHTFPAVLQSS
GLYSLSSVVTVPSSSLGTQTYICNVNHKPSNT
KVDKKVEPKSCDKTHTCPPCPAPPVAGPDVF
LFPPKPKDTLMISRTPEVTCVVVDVSHEDPEV
KFNWYVDGVEVHNAKTKPREEQYNSTYRV
VSVLTVLHQDWLNGKEYKCKVSNAALPAPI
AKTISKAKGQPREPQVYTLPPSRDELTKNQVS
LTCLVKGFYPSDIAVEWESNGQPENNYKTTP
PVLDSDGSFFLYSKLTVDKSRWQQGNVFSCS
VMHEALHNRFTQKSLSLSPGKGGGGSGGGG
SGGGGSGGGGSMLPAPKNLVVSRVTEDSAR
LSWTAPDAAFDSFHIEYAEPWVWGEAIVLTV
PGSERSYDLTGLKPGTEYVVFIGGVKGGHNS
TPLSAIFTTGGGGSGGGGSGGGGSGGGGSML
PAPKNLVVSRVTEDSARLSWTAPDAAFDSFW
ITYEEKFYRGEAIVLTVPGSERSYDLTGLKPG
TEYKVWIVGVKGGQGSWPLSAIFTT |
| 926 | PRT | Human | PagibaximabHC156 | EVMLVESGGGLVQPKGSLKLSCAASGFTFNN
YAMNWVRQAPGKGLEWVARIRSKSNNYAT
FYADSVKDRFTISRDDSQSMLYLQMNNLKTE
DTAMYYCVRRGASGIDYAMDYWGQGTSLT
VSSASTKGPSVFPLAPSSKSTSGGTAALGCLV
KDYFPEPVTVSWNSGALTSGVHTFPAVLQSS
GLYSLSSVVTVPSSSLGTQTYICNVNHKPSNT
KVDKKVEPKSCDKTHTCPPCPAPPVAGPDVF
LFPPKPKDTLMISRTPEVTCVVVDVSHEDPEV
KFNWYVDGVEVHNAKTKPREEQYNSTYRV
VSVLTVLHQDWLNGKEYKCKVSNAALPAPI
AKTISKAKGQPREPQVYTLPPSRDELTKNQVS
LTCLVKGFYPSDIAVEWESNGQPENNYKTTP
PVLDSDGSFFLYSKLTVDKSRWQQGNVFSCS
VMHEALHNHYTQKSLSLSPGKGGGGSGGGG
SGGGGSGGGGSMLPAPKNLVVSRVTEDSAR
LSWTAPDAAFDSFHIEYAEPWVWGEAIVLTV
PGSERSYDLTGLKPGTEYVVFIGGVKGGHNS
TPLSAIFTTGGGGSGGGGSGGGGSGGGGSML
PAPKNLVVSRVTEDSARLSWTAPDAAFDSFW
ITYEEKFYRGEAIVLTVPGSERSYDLTGLKPG
TEYKVWIVGVKGGQGSWPLSAIFTT |
| 927 | PRT | Human | RSVHC157 | QITLKESGPTLVKPTQTLTLTCTFSGFSLSTSG
MGVSWIRQPPGKALEWLAHIYWDDDKRYNP
SLKSRLTITKDTSKNQVVLTMTNMDPVDTAT
YYCARLYGFTYGFAYWGQGTLVTVSSASTK
GPSVFPLAPSSKSTSGGTAALGCLVKDYFPEP
VTVSWNSGALTSGVHTFPAVLQSSGLYSLSS
VVTVPSSSLGTQTYICNVNHKPSNTKVDKKV
EPKSCDKTHTCPPCPAPPVAGPDVFLFPPKPK
DTLMISRTPEVTCVVVDVSHEDPEVKFNWYV
DGVEVHNAKTKPREEQYNSTYRVVSVLTVL
HQDWLNGKEYKCKVSNAALPAPIAKTISKAK
GQPREPQVYTLPPSRDELTKNQVSLTCLVKG
FYPSDIAVEWESNGQPENNYKTTPPVLDSDG
SFFLYSKLTVDKSRWQQGNVFSCSVMHEAL
HNRFTQKSLSLSPGKGGGGSGGGGSGGGGSG
GGGSMLPAPKNLVVSRVTEDSARLSWTAPD
AAFDSFHIEYAEPWVWGEAIVLTVPGSERSY
DLTGLKPGTEYVVFIGGVKGGHNSTPLSAIFT
TGGGGSGGGGSGGGGSGGGGSMLPAPKNLV
VSRVTEDSARLSWTAPDAAFDSFWITYEEKF
YRGEAIVLTVPGSERSYDLTGLKPGTEYKVW
IVGVKGGQGSWPLSAIFTT |
| 928 | PRT | Human | RSVHC158 | QITLKESGPTLVKPTQTLTLTCTFSGFSLSTSG
MGVSWIRQPPGKALEWLAHIYWDDDKRYNP
SLKSRLTITKDTSKNQVVLTMTNMDPVDTAT
YYCARLYGFTYGFAYWGQGTLVTVSSASTK
GPSVFPLAPSSKSTSGGTAALGCLVKDYFPEP
VTVSWNSGALTSGVHTFPAVLQSSGLYSLSS
VVTVPSSSLGTQTYICNVNHKPSNTKVDKKV
EPKSCDKTHTCPPCPAPPVAGPDVFLFPPKPK
DTLMISRTPEVTCVVVDVSHEDPEVKFNWYV
DGVEVHNAKTKPREEQYNSTYRVVSVLTVL
HQDWLNGKEYKCKVSNAALPAPIAKTISKAK |

TABLE 6-continued

Nucleic Acid and Amino Acid Sequences of the Disclosure

| SEQ ID NO: | Type | Species | Description | Sequence |
|---|---|---|---|---|
| | | | | GQPREPQVYTLPPSRDELTKNQVSLTCLVKG FYPSDIAVEWESNGQPENNYKTTPPVLDSDG SFFLYSKLTVDKSRWQQGNVFSCSVMHEAL HNHYTQKSLSLSPGKGGGGSGGGGSGGGGS GGGGSMLPAPKNLVVSRVTEDSARLSWTAP DAAFDSFHIEYAEPWVWGEAIVLTVPGSERS YDLTGLKPGTEYVVFIGGVKGGHNSTPLSAIF TTGGGGSGGGGSGGGGSGGGGSMLPAPKNL VVSRVTEDSARLSWTAPDAAFDSFWITYEEK FYRGEAIVLTVPGSERSYDLTGLKPGTEYKV WIVGVKGGQGSWPLSAIFTT |
| 929 | PRT | Human | CR-6171HC159 | EVQLVETGGVAVQPGRSLRLSCAASGFSFRD YGMHWVRQAAGKGLEWVAFIWPHGVNRFY ADSMEGRFTISRDDSKNMLYLEMNNLRTEDT ALYYCTRDQDYVPRKYFDLWGRGTLVTVSS ASTKGPSVFPLAPSSKSTSGGTAALGCLVKD YFPEPVTVSWNSGALTSGVHTFPAVLQSSGL YSLSSVVTVPSSSLGTQTYICNVNHKPSNTKV DKKVEPKSCDKTHTCPPCPAPPVAGPDVFLFP PKPKDTLMISRTPEVTCVVVDVSHEDPEVKF NWYVDGVEVHNAKTKPREEQYNSTYRVVS VLTVLHQDWLNGKEYKCKVSNAALPAPIAK TISKAKGQPREPQVYTLPPSRDELTKNQVSLT CLVKGFYPSDIAVEWESNGQPENNYKTTPPV LDSDGSFFLYSKLTVDKSRWQQGNVFSCSV MHEALHNRFTQKSLSLSPGKGGGGSGGGGS GGGGSGGGGSMLPAPKNLVVSRVTEDSARL SWTAPDAAFDSFHIEYAEPWVWGEAIVLTVP GSERSYDLTGLKPGTEYVVFIGGVKGGHNST PLSAIFTTGGGGSGGGGSGGGGSGGGGSMLP APKNLVVSRVTEDSARLSWTAPDAAFDSFWI TYEEKFYRGEAIVLTVPGSERSYDLTGLKPGT EYKVWIVGVKGGQGSWPLSAIFTT |
| 930 | PRT | Human | CR-6171HC160 | EVQLVETGGVAVQPGRSLRLSCAASGFSFRD YGMHWVRQAAGKGLEWVAFIWPHGVNRFY ADSMEGRFTISRDDSKNMLYLEMNNLRTEDT ALYYCTRDQDYVPRKYFDLWGRGTLVTVSS ASTKGPSVFPLAPSSKSTSGGTAALGCLVKD YFPEPVTVSWNSGALTSGVHTFPAVLQSSGL YSLSSVVTVPSSSLGTQTYICNVNHKPSNTKV DKKVEPKSCDKTHTCPPCPAPPVAGPDVFLFP PKPKDTLMISRTPEVTCVVVDVSHEDPEVKF NWYVDGVEVHNAKTKPREEQYNSTYRVVS VLTVLHQDWLNGKEYKCKVSNAALPAPIAK TISKAKGQPREPQVYTLPPSRDELTKNQVSLT CLVKGFYPSDIAVEWESNGQPENNYKTTPPV LDSDGSFFLYSKLTVDKSRWQQGNVFSCSV MHEALHNHYTQKSLSLSPGKGGGGSGGGGS GGGGSGGGGSMLPAPKNLVVSRVTEDSARL SWTAPDAAFDSFHIEYAEPWVWGEAIVLTVP GSERSYDLTGLKPGTEYVVFIGGVKGGHNST PLSAIFTTGGGGSGGGGSGGGGSGGGGSMLP APKNLVVSRVTEDSARLSWTAPDAAFDSFWI TYEEKFYRGEAIVLTVPGSERSYDLTGLKPGT EYKVWIVGVKGGQGSWPLSAIFTT |
| 931 | PRT | Human | CR-5133HC161 | EVQLVETGGGLVKPGGSLRLSCSASRFSFRD YYMTWIRQAPGKGPEWVSHISGSGSTIYYAD SVRGRFTISRDNAKSSLYLQMDSLQADDTAV YYCARGGRATSYYWVHWPGTLVTVSSAST KGPSVFPLAPSSKSTSGGTAALGCLVKDYFPE PVTVSWNSGALTSGVHTFPAVLQSSGLYSLS SVVTVPSSSLGTQTYICNVNHKPSNTKVDKK VEPKSCDKTHTCPPCPAPPVAGPDVFLFPPKP KDTLMISRTPEVTCVVVDVSHEDPEVKFNWY VDGVEVHNAKTKPREEQYNSTYRVVSVLTV LHQDWLNGKEYKCKVSNAALPAPIAKTISKA KGQPREPQVYTLPPSRDELTKNQVSLTCLVK GFYPSDIAVEWESNGQPENNYKTTPPVLDSD GSFFLYSKLTVDKSRWQQGNVFSCSVMHEA LHNRFTQKSLSLSPGKMLPAPKNLVVSRVTE DSARLSWTAPDAAFDSFHIEYAEPWVWGEAI VLTVPGSERSYDLTGLKPGTEYVVFIGGVKG |

TABLE 6-continued

Nucleic Acid and Amino Acid Sequences of the Disclosure

| SEQ ID NO: | Type | Species | Description | Sequence |
|---|---|---|---|---|
| | | | | GHNSTPLSAIFTTMLPAPKNLVVSRVTEDSAR LSWTAPDAAFDSFWITYEEKFYRGEAIVLTVP GSERSYDLTGLKPGTEYKVWIVGVKGGQGS WPLSAIFTT |
| 932 | PRT | Human | CR-5133HC162 | EVQLVETGGGLVKPGGSLRLSCSASRFSFRD YYMTWIRQAPGKGPEWVSHISGSGSTIYYAD SVRGRFTISRDNAKSSLYLQMDSLQADDTAV YYCARGGRATSYYWVHWGPGTLVTVSSAST KGPSVFPLAPSSKSTSGGTAALGCLVKDYFPE PVTVSWNSGALTSGVHTFPAVLQSSGLYSLS SVVTVPSSSLGTQTYICNVNHKPSNTKVDKK VEPKSCDKTHTCPPCPAPPVAGPDVFLFPPKP KDTLMISRTPEVTCVVVDVSHEDPEVKFNWY VDGVEVHNAKTKPREEQYNSTYRVVSVLTV LHQDWLNGKEYKCKVSNAALPAPIAKTISKA KGQPREPQVYTLPPSRDELTKNQVSLTCLVK GFYPSDIAVEWESNGQPENNYKTTPPVLDSD GSFFLYSKLTVDKSRWQQGNVFSCSVMHEA LHNRFTQKSLSLSPGKMLPAPKNLVVSRVTE DSARLSWTAPDAAFDSFHIEYAEPWVWGEAI VLTVPGSERSYDLTGLKPGTEYVVFIGGVKG GHNSTPLSAIFTTGGGSMLPAPKNLVVSRV TEDSARLSWTAPDAAFDSFWITYEEKFYRGE AIVLTVPGSERSYDLTGLKPGTEYKVWIVGV KGGQGSWPLSAIFTT |
| 933 | PRT | Human | CR-5133HC163 | EVQLVETGGGLVKPGGSLRLSCSASRFSFRD YYMTWIRQAPGKGPEWVSHISGSGSTIYYAD SVRGRFTISRDNAKSSLYLQMDSLQADDTAV YYCARGGRATSYYWVHWGPGTLVTVSSAST KGPSVFPLAPSSKSTSGGTAALGCLVKDYFPE PVTVSWNSGALTSGVHTFPAVLQSSGLYSLS SVVTVPSSSLGTQTYICNVNHKPSNTKVDKK VEPKSCDKTHTCPPCPAPPVAGPDVFLFPPKP KDTLMISRTPEVTCVVVDVSHEDPEVKFNWY VDGVEVHNAKTKPREEQYNSTYRVVSVLTV LHQDWLNGKEYKCKVSNAALPAPIAKTISKA KGQPREPQVYTLPPSRDELTKNQVSLTCLVK GFYPSDIAVEWESNGQPENNYKTTPPVLDSD GSFFLYSKLTVDKSRWQQGNVFSCSVMHEA LHNRFTQKSLSLSPGKMLPAPKNLVVSRVTE DSARLSWTAPDAAFDSFHIEYAEPWVWGEAI VLTVPGSERSYDLTGLKPGTEYVVFIGGVKG GHNSTPLSAIFTTGGGSGGGGSMLPAPKNL VVSRVTEDSARLSWTAPDAAFDSFWITYEEK FYRGEAIVLTVPGSERSYDLTGLKPGTEYKV WIVGVKGGQGSWPLSAIFTT |
| 934 | PRT | Human | CR-5133HC164 | EVQLVETGGGLVKPGGSLRLSCSASRFSFRD YYMTWIRQAPGKGPEWVSHISGSGSTIYYAD SVRGRFTISRDNAKSSLYLQMDSLQADDTAV YYCARGGRATSYYWVHWGPGTLVTVSSAST KGPSVFPLAPSSKSTSGGTAALGCLVKDYFPE PVTVSWNSGALTSGVHTFPAVLQSSGLYSLS SVVTVPSSSLGTQTYICNVNHKPSNTKVDKK VEPKSCDKTHTCPPCPAPPVAGPDVFLFPPKP KDTLMISRTPEVTCVVVDVSHEDPEVKFNWY VDGVEVHNAKTKPREEQYNSTYRVVSVLTV LHQDWLNGKEYKCKVSNAALPAPIAKTISKA KGQPREPQVYTLPPSRDELTKNQVSLTCLVK GFYPSDIAVEWESNGQPENNYKTTPPVLDSD GSFFLYSKLTVDKSRWQQGNVFSCSVMHEA LHNRFTQKSLSLSPGKMLPAPKNLVVSRVTE DSARLSWTAPDAAFDSFHIEYAEPWVWGEAI VLTVPGSERSYDLTGLKPGTEYVVFIGGVKG GHNSTPLSAIFTTGGGSGGGGSGGGGSMLP APKNLVVSRVTEDSARLSWTAPDAAFDSFWI TYEEKFYRGEAIVLTVPGSERSYDLTGLKPGT EYKVWIVGVKGGQGSWPLSAIFTT |
| 935 | PRT | Human | CR-5133HC165 | EVQLVETGGGLVKPGGSLRLSCSASRFSFRD YYMTWIRQAPGKGPEWVSHISGSGSTIYYAD SVRGRFTISRDNAKSSLYLQMDSLQADDTAV YYCARGGRATSYYWVHWGPGTLVTVSSAST |

TABLE 6-continued

Nucleic Acid and Amino Acid Sequences of the Disclosure

| SEQ ID NO: | Type | Species | Description | Sequence |
|---|---|---|---|---|
| | | | | KGPSVFPLAPSSKSTSGGTAALGCLVKDYFPE PVTVSWNSGALTSGVHTFPAVLQSSGLYSLS SVVTVPSSSLGTQTYICNVNHKPSNTKVDKK VEPKSCDKTHTCPPCPAPPVAGPDVFLFPPKP KDTLMISRTPEVTCVVVDVSHEDPEVKFNWY VDGVEVHNAKTKPREEQYNSTYRVVSVLTV LHQDWLNGKEYKCKVSNAALPAPIAKTISKA KGQPREPQVYTLPPSRDELTKNQVSLTCLVK GFYPSDIAVEWESNGQPENNYKTTPPVLDSD GSFFLYSKLTVDKSRWQQGNVFSCSVMHEA LHNRFTQKSLSLSPGKMLPAPKNLVVSRVTE DSARLSWTAPDAAFDSFHIEYAEPWVWGEAI VLTVPGSERSYDLTGLKPGTEYVVFIGGVKG GHNSTPLSAIFTTGGGGSGGGGSGGGGSGGG GSMLPAPKNLVVSRVTEDSARLSWTAPDAAF DSFWITYEEKFYRGEAIVLTVPGSERSYDLTG LKPGTEYKVWIVGVKGGQGSWPLSAIFTT |
| 936 | PRT | Human | CR-5133HC166 | EVQLVETGGGLVKPGGSLRLSCSASRFSFRD YYMTWIRQAPGKGPEWVSHISGSGSTIYYAD SVRGRFTISRDNAKSSLYLQMDSLQADDTAV YYCARGGRATSYYWVHWGPGTLVTVSSAST KGPSVFPLAPSSKSTSGGTAALGCLVKDYFPE PVTVSWNSGALTSGVHTFPAVLQSSGLYSLS SVVTVPSSSLGTQTYICNVNHKPSNTKVDKK VEPKSCDKTHTCPPCPAPPVAGPDVFLFPPKP KDTLMISRTPEVTCVVVDVSHEDPEVKFNWY VDGVEVHNAKTKPREEQYNSTYRVVSVLTV LHQDWLNGKEYKCKVSNAALPAPIAKTISKA KGQPREPQVYTLPPSRDELTKNQVSLTCLVK GFYPSDIAVEWESNGQPENNYKTTPPVLDSD GSFFLYSKLTVDKSRWQQGNVFSCSVMHEA LHNRFTQKSLSLSPGKGGGGSMLPAPKNLVV SRVTEDSARLSWTAPDAAFDSFHIEYAEPWV WGEAIVLTVPGSERSYDLTGLKPGTEYVVFIG GVKGGHNSTPLSAIFTTMLPAPKNLVVSRVT EDSARLSWTAPDAAFDSFWITYEEKFYRGEA IVLTVPGSERSYDLTGLKPGTEYKVWIVGVK GGQGSWPLSAIFTT |
| 937 | PRT | Human | CR-5133HC167 | EVQLVETGGGLVKPGGSLRLSCSASRFSFRD YYMTWIRQAPGKGPEWVSHISGSGSTIYYAD SVRGRFTISRDNAKSSLYLQMDSLQADDTAV YYCARGGRATSYYWVHWGPGTLVTVSSAST KGPSVFPLAPSSKSTSGGTAALGCLVKDYFPE PVTVSWNSGALTSGVHTFPAVLQSSGLYSLS SVVTVPSSSLGTQTYICNVNHKPSNTKVDKK VEPKSCDKTHTCPPCPAPPVAGPDVFLFPPKP KDTLMISRTPEVTCVVVDVSHEDPEVKFNWY VDGVEVHNAKTKPREEQYNSTYRVVSVLTV LHQDWLNGKEYKCKVSNAALPAPIAKTISKA KGQPREPQVYTLPPSRDELTKNQVSLTCLVK GFYPSDIAVEWESNGQPENNYKTTPPVLDSD GSFFLYSKLTVDKSRWQQGNVFSCSVMHEA LHNRFTQKSLSLSPGKGGGGSMLPAPKNLVV SRVTEDSARLSWTAPDAAFDSFHIEYAEPWV WGEAIVLTVPGSERSYDLTGLKPGTEYVVFIG GVKGGHNSTPLSAIFTTGGGGSMLPAPKNLV VSRVTEDSARLSWTAPDAAFDSFWITYEEKF YRGEAIVLTVPGSERSYDLTGLKPGTEYKVW IVGVKGGQGSWPLSAIFTT |
| 938 | PRT | Human | CR-5133HC168 | EVQLVETGGGLVKPGGSLRLSCSASRFSFRD YYMTWIRQAPGKGPEWVSHISGSGSTIYYAD SVRGRFTISRDNAKSSLYLQMDSLQADDTAV YYCARGGRATSYYWVHWGPGTLVTVSSAST KGPSVFPLAPSSKSTSGGTAALGCLVKDYFPE PVTVSWNSGALTSGVHTFPAVLQSSGLYSLS SVVTVPSSSLGTQTYICNVNHKPSNTKVDKK VEPKSCDKTHTCPPCPAPPVAGPDVFLFPPKP KDTLMISRTPEVTCVVVDVSHEDPEVKFNWY VDGVEVHNAKTKPREEQYNSTYRVVSVLTV LHQDWLNGKEYKCKVSNAALPAPIAKTISKA KGQPREPQVYTLPPSRDELTKNQVSLTCLVK GFYPSDIAVEWESNGQPENNYKTTPPVLDSD |

TABLE 6-continued

Nucleic Acid and Amino Acid Sequences of the Disclosure

| SEQ ID NO: | Type | Species | Description | Sequence |
|---|---|---|---|---|
| | | | | GSFFLYSKLTVDKSRWQQGNVFSCSVMHEA
LHNRFTQKSLSLSPGKGGGGSMLPAPKNLVV
SRVTEDSARLSWTAPDAAFDSFHIEYAEPWV
WGEAIVLTVPGSERSYDLTGLKPGTEYVVFIG
GVKGGHNSTPLSAIFTTGGGSGGGGSMLPA
PKNLVVSRVTEDSARLSWTAPDAAFDSFWIT
YEEKFYRGEAIVLTVPGSERSYDLTGLKPGTE
YKVWIVGVKGGQGSWPLSAIFTT |
| 939 | PRT | Human | CR-5133HC169 | EVQLVETGGGLVKPGGSLRLSCSASRFSFRD
YYMTWIRQAPGKGPEWVSHISGSGSTIYYAD
SVRGRFTISRDNAKSSLYLQMDSLQADDTAV
YYCARGGRATSYYWVHWGPGTLVTVSSAST
KGPSVFPLAPSSKSTSGGTAALGCLVKDYFPE
PVTVSWNSGALTSGVHTFPAVLQSSGLYSLS
SVVTVPSSSLGTQTYICNVNHKPSNTKVDKK
VEPKSCDKTHTCPPCPAPPVAGPDVFLFPPKP
KDTLMISRTPEVTCVVVDVSHEDPEVKFNWY
VDGVEVHNAKTKPREEQYNSTYRVVSVLTV
LHQDWLNGKEYKCKVSNAALPAPIAKTISKA
KGQPREPQVYTLPPSRDELTKNQVSLTCLVK
GFYPSDIAVEWESNGQPENNYKTTPPVLDSD
GSFFLYSKLTVDKSRWQQGNVFSCSVMHEA
LHNRFTQKSLSLSPGKGGGGSMLPAPKNLVV
SRVTEDSARLSWTAPDAAFDSFHIEYAEPWV
WGEAIVLTVPGSERSYDLTGLKPGTEYVVFIG
GVKGGHNSTPLSAIFTTGGGSGGGGSGGGG
SMLPAPKNLVVSRVTEDSARLSWTAPDAAFD
SFWITYEEKFYRGEAIVLTVPGSERSYDLTGL
KPGTEYKVWIVGVKGGQGSWPLSAIFTT |
| 940 | PRT | Human | CR-5133HC170 | EVQLVETGGGLVKPGGSLRLSCSASRFSFRD
YYMTWIRQAPGKGPEWVSHISGSGSTIYYAD
SVRGRFTISRDNAKSSLYLQMDSLQADDTAV
YYCARGGRATSYYWVHWGPGTLVTVSSAST
KGPSVFPLAPSSKSTSGGTAALGCLVKDYFPE
PVTVSWNSGALTSGVHTFPAVLQSSGLYSLS
SVVTVPSSSLGTQTYICNVNHKPSNTKVDKK
VEPKSCDKTHTCPPCPAPPVAGPDVFLFPPKP
KDTLMISRTPEVTCVVVDVSHEDPEVKFNWY
VDGVEVHNAKTKPREEQYNSTYRVVSVLTV
LHQDWLNGKEYKCKVSNAALPAPIAKTISKA
KGQPREPQVYTLPPSRDELTKNQVSLTCLVK
GFYPSDIAVEWESNGQPENNYKTTPPVLDSD
GSFFLYSKLTVDKSRWQQGNVFSCSVMHEA
LHNRFTQKSLSLSPGKGGGGSMLPAPKNLVV
SRVTEDSARLSWTAPDAAFDSFHIEYAEPWV
WGEAIVLTVPGSERSYDLTGLKPGTEYVVFIG
GVKGGHNSTPLSAIFTTGGGSGGGGSGGGG
SGGGGSMLPAPKNLVVSRVTEDSARLSWTAP
DAAFDSFWITYEEKFYRGEAIVLTVPGSERSY
DLTGLKPGTEYKVWIVGVKGGQGSWPLSAIF
TT |
| 941 | PRT | Human | CR-5133HC171 | EVQLVETGGGLVKPGGSLRLSCSASRFSFRD
YYMTWIRQAPGKGPEWVSHISGSGSTIYYAD
SVRGRFTISRDNAKSSLYLQMDSLQADDTAV
YYCARGGRATSYYWVHWGPGTLVTVSSAST
KGPSVFPLAPSSKSTSGGTAALGCLVKDYFPE
PVTVSWNSGALTSGVHTFPAVLQSSGLYSLS
SVVTVPSSSLGTQTYICNVNHKPSNTKVDKK
VEPKSCDKTHTCPPCPAPPVAGPDVFLFPPKP
KDTLMISRTPEVTCVVVDVSHEDPEVKFNWY
VDGVEVHNAKTKPREEQYNSTYRVVSVLTV
LHQDWLNGKEYKCKVSNAALPAPIAKTISKA
KGQPREPQVYTLPPSRDELTKNQVSLTCLVK
GFYPSDIAVEWESNGQPENNYKTTPPVLDSD
GSFFLYSKLTVDKSRWQQGNVFSCSVMHEA
LHNRFTQKSLSLSPGKGGGGSGGGGSMLPAP
KNLVVSRVTEDSARLSWTAPDAAFDSFHIEY
AEPWVWGEAIVLTVPGSERSYDLTGLKPGTE
YVVFIGGVKGGHNSTPLSAIFTTMLPAPKNLV
VSRVTEDSARLSWTAPDAAFDSFWITYEEKF
YRGEAIVLTVPGSERSYDLTGLKPGTEYKVW
IVGVKGGQGSWPLSAIFTT |

TABLE 6-continued

Nucleic Acid and Amino Acid Sequences of the Disclosure

| SEQ ID NO: | Type | Species | Description | Sequence |
|---|---|---|---|---|
| 942 | PRT | Human | CR-5133HC172 | EVQLVETGGGLVKPGGSLRLSCSASRFSFRD YYMTWIRQAPGKGPEWVSHISGSGSTIYYAD SVRGRFTISRDNAKSSLYLQMDSLQADDTAV YYCARGGRATSYYWVHWGPGTLVTVSSAST KGPSVFPLAPSSKSTSGGTAALGCLVKDYFPE PVTVSWNSGALTSGVHTFPAVLQSSGLYSLS SVVTVPSSSLGTQTYICNVNHKPSNTKVDKK VEPKSCDKTHTCPPCPAPPVAGPDVFLFPPKP KDTLMISRTPEVTCVVVDVSHEDPEVKFNWY VDGVEVHNAKTKPREEQYNSTYRVVSVLTV LHQDWLNGKEYKCKVSNAALPAPIAKTISKA KGQPREPQVYTLPPSRDELTKNQVSLTCLVK GFYPSDIAVEWESNGQPENNYKTTPPVLDSD GSFFLYSKLTVDKSRWQQGNVFSCSVMHEA LHNRFTQKSLSLSPGKGGGGSGGGGSMLPAP KNLVVSRVTEDSARLSWTAPDAAFDSFHIEY AEPWVWGEAIVLTVPGSERSYDLTGLKPGTE YVVFIGGVKGGHNSTPLSAIFTTGGGGSMLP APKNLVVSRVTEDSARLSWTAPDAAFDSFWI TYEEKFYRGEAIVLTVPGSERSYDLTGLKPGT EYKVWIVGVKGGQGSWPLSAIFTT |
| 943 | PRT | Human | CR-5133HC173 | EVQLVETGGGLVKPGGSLRLSCSASRFSFRD YYMTWIRQAPGKGPEWVSHISGSGSTIYYAD SVRGRFTISRDNAKSSLYLQMDSLQADDTAV YYCARGGRATSYYWVHWGPGTLVTVSSAST KGPSVFPLAPSSKSTSGGTAALGCLVKDYFPE PVTVSWNSGALTSGVHTFPAVLQSSGLYSLS SVVTVPSSSLGTQTYICNVNHKPSNTKVDKK VEPKSCDKTHTCPPCPAPPVAGPDVFLFPPKP KDTLMISRTPEVTCVVVDVSHEDPEVKFNWY VDGVEVHNAKTKPREEQYNSTYRVVSVLTV LHQDWLNGKEYKCKVSNAALPAPIAKTISKA KGQPREPQVYTLPPSRDELTKNQVSLTCLVK GFYPSDIAVEWESNGQPENNYKTTPPVLDSD GSFFLYSKLTVDKSRWQQGNVFSCSVMHEA LHNRFTQKSLSLSPGKGGGGSGGGGSMLPAP KNLVVSRVTEDSARLSWTAPDAAFDSFHIEY AEPWVWGEAIVLTVPGSERSYDLTGLKPGTE YVVFIGGVKGGHNSTPLSAIFTTGGGGSGGG GSMLPAPKNLVVSRVTEDSARLSWTAPDAAF DSFWITYEEKFYRGEAIVLTVPGSERSYDLTG LKPGTEYKVWIVGVKGGQGSWPLSAIFTT |
| 944 | PRT | Human | CR-5133HC174 | EVQLVETGGGLVKPGGSLRLSCSASRFSFRD YYMTWIRQAPGKGPEWVSHISGSGSTIYYAD SVRGRFTISRDNAKSSLYLQMDSLQADDTAV YYCARGGRATSYYWVHWGPGTLVTVSSAST KGPSVFPLAPSSKSTSGGTAALGCLVKDYFPE PVTVSWNSGALTSGVHTFPAVLQSSGLYSLS SVVTVPSSSLGTQTYICNVNHKPSNTKVDKK VEPKSCDKTHTCPPCPAPPVAGPDVFLFPPKP KDTLMISRTPEVTCVVVDVSHEDPEVKFNWY VDGVEVHNAKTKPREEQYNSTYRVVSVLTV LHQDWLNGKEYKCKVSNAALPAPIAKTISKA KGQPREPQVYTLPPSRDELTKNQVSLTCLVK GFYPSDIAVEWESNGQPENNYKTTPPVLDSD GSFFLYSKLTVDKSRWQQGNVFSCSVMHEA LHNRFTQKSLSLSPGKGGGGSGGGGSMLPAP KNLVVSRVTEDSARLSWTAPDAAFDSFHIEY AEPWVWGEAIVLTVPGSERSYDLTGLKPGTE YVVFIGGVKGGHNSTPLSAIFTTGGGGSGGG GSGGGGSMLPAPKNLVVSRVTEDSARLSWT APDAAFDSFWITYEEKFYRGEAIVLTVPGSER SYDLTGLKPGTEYKVWIVGVKGGQGSWPLS AIFTT |
| 945 | PRT | Human | CR-5133HC175 | EVQLVETGGGLVKPGGSLRLSCSASRFSFRD YYMTWIRQAPGKGPEWVSHISGSGSTIYYAD SVRGRFTISRDNAKSSLYLQMDSLQADDTAV YYCARGGRATSYYWVHWGPGTLVTVSSAST KGPSVFPLAPSSKSTSGGTAALGCLVKDYFPE PVTVSWNSGALTSGVHTFPAVLQSSGLYSLS SVVTVPSSSLGTQTYICNVNHKPSNTKVDKK |

TABLE 6-continued

Nucleic Acid and Amino Acid Sequences of the Disclosure

| SEQ ID NO: | Type | Species | Description | Sequence |
|---|---|---|---|---|
| | | | | VEPKSCDKTHTCPPCPAPPVAGPDVFLFPPKP KDTLMISRTPEVTCVVVDVSHEDPEVKFNWY VDGVEVHNAKTKPREEQYNSTYRVVSVLTV LHQDWLNGKEYKCKVSNAALPAPIAKTISKA KGQPREPQVYTLPPSRDELTKNQVSLTCLVK GFYPSDIAVEWESNGQPENNYKTTPPVLDSD GSFFLYSKLTVDKSRWQQGNVFSCSVMHEA LHNRFTQKSLSLSPGKGGGGSGGGGSMLPAP KNLVVSRVTEDSARLSWTAPDAAFDSFHIEY AEPWVWGEAIVLTVPGSERSYDLTGLKPGTE YVVFIGGVKGGHNSTPLSAIFTTGGGSGGG GSGGGGSGGGGSMLPAPKNLVVSRVTEDSA RLSWTAPDAAFDSFWITYEEKFYRGEAIVLT VPGSERSYDLTGLKPGTEYKVWIVGVKGGQ GSWPLSAIFTT |
| 946 | PRT | Human | CR-5133HC176 | EVQLVETGGGLVKPGGSLRLSCSASRFSFRD YYMTWIRQAPGKGPEWVSHISGSGSTIYYAD SVRGRFTISRDNAKSSLYLQMDSLQADDTAV YYCARGGRATSYYWVHWGPGTLVTVSSAST KGPSVFPLAPSSKSTSGGTAALGCLVKDYFPE PVTVSWNSGALTSGVHTFPAVLQSSGLYSLS SVVTVPSSSLGTQTYICNVNHKPSNTKVDKK VEPKSCDKTHTCPPCPAPPVAGPDVFLFPPKP KDTLMISRTPEVTCVVVDVSHEDPEVKFNWY VDGVEVHNAKTKPREEQYNSTYRVVSVLTV LHQDWLNGKEYKCKVSNAALPAPIAKTISKA KGQPREPQVYTLPPSRDELTKNQVSLTCLVK GFYPSDIAVEWESNGQPENNYKTTPPVLDSD GSFFLYSKLTVDKSRWQQGNVFSCSVMHEA LHNRFTQKSLSLSPGKGGGGSGGGGSGGGGS MLPAPKNLVVSRVTEDSARLSWTAPDAAFDS FHIEYAEPWVWGEAIVLTVPGSERSYDLTGL KPGTEYVVFIGGVKGGHNSTPLSAIFTTMLPA PKNLVVSRVTEDSARLSWTAPDAAFDSFWIT YEEKFYRGEAIVLTVPGSERSYDLTGLKPGTE YKVWIVGVKGGQGSWPLSAIFTT |
| 947 | PRT | Human | CR-5133HC177 | EVQLVETGGGLVKPGGSLRLSCSASRFSFRD YYMTWIRQAPGKGPEWVSHISGSGSTIYYAD SVRGRFTISRDNAKSSLYLQMDSLQADDTAV YYCARGGRATSYYWVHWGPGTLVTVSSAST KGPSVFPLAPSSKSTSGGTAALGCLVKDYFPE PVTVSWNSGALTSGVHTFPAVLQSSGLYSLS SVVTVPSSSLGTQTYICNVNHKPSNTKVDKK VEPKSCDKTHTCPPCPAPPVAGPDVFLFPPKP KDTLMISRTPEVTCVVVDVSHEDPEVKFNWY VDGVEVHNAKTKPREEQYNSTYRVVSVLTV LHQDWLNGKEYKCKVSNAALPAPIAKTISKA KGQPREPQVYTLPPSRDELTKNQVSLTCLVK GFYPSDIAVEWESNGQPENNYKTTPPVLDSD GSFFLYSKLTVDKSRWQQGNVFSCSVMHEA LHNRFTQKSLSLSPGKGGGGSGGGGSGGGGS MLPAPKNLVVSRVTEDSARLSWTAPDAAFDS FHIEYAEPWVWGEAIVLTVPGSERSYDLTGL KPGTEYVVFIGGVKGGHNSTPLSAIFTTGGGG SMLPAPKNLVVSRVTEDSARLSWTAPDAAFD SFWITYEEKFYRGEAIVLTVPGSERSYDLTGL KPGTEYKVWIVGVKGGQGSWPLSAIFTT |
| 948 | PRT | Human | CR-5133HC178 | EVQLVETGGGLVKPGGSLRLSCSASRFSFRD YYMTWIRQAPGKGPEWVSHISGSGSTIYYAD SVRGRFTISRDNAKSSLYLQMDSLQADDTAV YYCARGGRATSYYWVHWGPGTLVTVSSAST KGPSVFPLAPSSKSTSGGTAALGCLVKDYFPE PVTVSWNSGALTSGVHTFPAVLQSSGLYSLS SVVTVPSSSLGTQTYICNVNHKPSNTKVDKK VEPKSCDKTHTCPPCPAPPVAGPDVFLFPPKP KDTLMISRTPEVTCVVVDVSHEDPEVKFNWY VDGVEVHNAKTKPREEQYNSTYRVVSVLTV LHQDWLNGKEYKCKVSNAALPAPIAKTISKA KGQPREPQVYTLPPSRDELTKNQVSLTCLVK GFYPSDIAVEWESNGQPENNYKTTPPVLDSD GSFFLYSKLTVDKSRWQQGNVFSCSVMHEA LHNRFTQKSLSLSPGKGGGGSGGGGSGGGGS |

TABLE 6-continued

Nucleic Acid and Amino Acid Sequences of the Disclosure

| SEQ ID NO: | Type | Species | Description | Sequence |
|---|---|---|---|---|
| | | | | MLPAPKNLVVSRVTEDSARLSWTAPDAAFDS FHIEYAEPWVWGEAIVLTVPGSERSYDLTGL KPGTEYVVFIGGVKGGHNSTPLSAIFTTGGGG SGGGGSMLPAPKNLVVSRVTEDSARLSWTAP DAAFDSFWITYEEKFYRGEAIVLTVPGSERSY DLTGLKPGTEYKVWIVGVKGGQGSWPLSAIF TT |
| 949 | PRT | Human | CR-5133HC179 | EVQLVETGGGLVKPGGSLRLSCSASRFSFRD YYMTWIRQAPGKGPEWVSHISGSGSTIYYAD SVRGRFTISRDNAKSSLYLQMDSLQADDTAV YYCARGGRATSYYWVHWGPGTLVTVSSAST KGPSVFPLAPSSKSTSGGTAALGCLVKDYFPE PVTVSWNSGALTSGVHTFPAVLQSSGLYSLS SVVTVPSSSLGTQTYICNVNHKPSNTKVDKK VEPKSCDKTHTCPPCPAPPVAGPDVFLFPPKP KDTLMISRTPEVTCVVVDVSHEDPEVKFNWY VDGVEVHNAKTKPREEQYNSTYRVVSVLTV LHQDWLNGKEYKCKVSNAALPAPIAKTISKA KGQPREPQVYTLPPSRDELTKNQVSLTCLVK GFYPSDIAVEWESNGQPENNYKTTPPVLDSD GSFFLYSKLTVDKSRWQQGNVFSCSVMHEA LHNRFTQKSLSLSPGKGGGGSGGGGSGGGGS MLPAPKNLVVSRVTEDSARLSWTAPDAAFDS FHIEYAEPWVWGEAIVLTVPGSERSYDLTGL KPGTEYVVFIGGVKGGHNSTPLSAIFTTGGGG SGGGGSGGGGSMLPAPKNLVVSRVTEDSAR LSWTAPDAAFDSFWITYEEKFYRGEAIVLTVP GSERSYDLTGLKPGTEYKVWIVGVKGGQGS WPLSAIFTT |
| 950 | PRT | Human | CR-5133HC180 | EVQLVETGGGLVKPGGSLRLSCSASRFSFRD YYMTWIRQAPGKGPEWVSHISGSGSTIYYAD SVRGRFTISRDNAKSSLYLQMDSLQADDTAV YYCARGGRATSYYWVHWGPGTLVTVSSAST KGPSVFPLAPSSKSTSGGTAALGCLVKDYFPE PVTVSWNSGALTSGVHTFPAVLQSSGLYSLS SVVTVPSSSLGTQTYICNVNHKPSNTKVDKK VEPKSCDKTHTCPPCPAPPVAGPDVFLFPPKP KDTLMISRTPEVTCVVVDVSHEDPEVKFNWY VDGVEVHNAKTKPREEQYNSTYRVVSVLTV LHQDWLNGKEYKCKVSNAALPAPIAKTISKA KGQPREPQVYTLPPSRDELTKNQVSLTCLVK GFYPSDIAVEWESNGQPENNYKTTPPVLDSD GSFFLYSKLTVDKSRWQQGNVFSCSVMHEA LHNRFTQKSLSLSPGKGGGGSGGGGSGGGGS MLPAPKNLVVSRVTEDSARLSWTAPDAAFDS FHIEYAEPWVWGEAIVLTVPGSERSYDLTGL KPGTEYVVFIGGVKGGHNSTPLSAIFTTGGGG SGGGGSGGGGSMLPAPKNLVVSRVT EDSARLSWTAPDAAFDSFWITYEEKFYRGEA IVLTVPGSERSYDLTGLKPGTEYKVWIVGVK GGQGSWPLSAIFTT |
| 951 | PRT | Human | CR-5133HC181 | EVQLVETGGGLVKPGGSLRLSCSASRFSFRD YYMTWIRQAPGKGPEWVSHISGSGSTIYYAD SVRGRFTISRDNAKSSLYLQMDSLQADDTAV YYCARGGRATSYYWVHWGPGTLVTVSSAST KGPSVFPLAPSSKSTSGGTAALGCLVKDYFPE PVTVSWNSGALTSGVHTFPAVLQSSGLYSLS SVVTVPSSSLGTQTYICNVNHKPSNTKVDKK VEPKSCDKTHTCPPCPAPPVAGPDVFLFPPKP KDTLMISRTPEVTCVVVDVSHEDPEVKFNWY VDGVEVHNAKTKPREEQYNSTYRVVSVLTV LHQDWLNGKEYKCKVSNAALPAPIAKTISKA KGQPREPQVYTLPPSRDELTKNQVSLTCLVK GFYPSDIAVEWESNGQPENNYKTTPPVLDSD GSFFLYSKLTVDKSRWQQGNVFSCSVMHEA LHNRFTQKSLSLSPGKGGGGSGGGGSGGGGS GGGGSMLPAPKNLVVSRVTEDSARLSWTAP DAAFDSFHIEYAEPWVWGEAIVLTVPGSERS YDLTGLKPGTEYVVFIGGVKGGHNSTPLSAIF TTMLPAPKNLVVSRVTEDSARLSWTAPDAAF DSFWITYEEKFYRGEAIVLTVPGSERSYDLTG LKPGTEYKVWIVGVKGGQGSWPLSAIFTT |

TABLE 6-continued

Nucleic Acid and Amino Acid Sequences of the Disclosure

| SEQ ID NO: | Type | Species | Description | Sequence |
|---|---|---|---|---|
| 952 | PRT | Human | CR-5133HC182 | EVQLVETGGGLVKPGGSLRLSCSASRFSFRD YYMTWIRQAPGKGPEWVSHISGSGSTIYYAD SVRGRFTISRDNAKSSLYLQMDSLQADDTAV YYCARGGRATSYYWVHWGPGTLVTVSSAST KGPSVFPLAPSSKSTSGGTAALGCLVKDYFPE PVTVSWNSGALTSGVHTFPAVLQSSGLYSLS SVVTVPSSSLGTQTYICNVNHKPSNTKVDKK VEPKSCDKTHTCPPCPAPPVAGPDVFLFPPKP KDTLMISRTPEVTCVVVDVSHEDPEVKFNWY VDGVEVHNAKTKPREEQYNSTYRVVSVLTV LHQDWLNGKEYKCKVSNAALPAPIAKTISKA KGQPREPQVYTLPPSRDELTKNQVSLTCLVK GFYPSDIAVEWESNGQPENNYKTTPPVLDSD GSFFLYSKLTVDKSRWQQGNVFSCSVMHEA LHNRFTQKSLSLSPGKGGGGSGGGGSGGGGS GGGGSMLPAPKNLVVSRVTEDSARLSWTAP DAAFDSFHIEYAEPWVWGEAIVLTVPGSERS YDLTGLKPGTEYVVFIGGVKGGHNSTPLSAIF TTGGGGSMLPAPKNLVVSRVTEDSARLSWT APDAAFDSFWITYEEKFYRGEAIVLTVPGSER SYDLTGLKPGTEYKVWIVGVKGGQGSWPLS AIFTT |
| 953 | PRT | Human | CR-5133HC183 | EVQLVETGGGLVKPGGSLRLSCSASRFSFRD YYMTWIRQAPGKGPEWVSHISGSGSTIYYAD SVRGRFTISRDNAKSSLYLQMDSLQADDTAV YYCARGGRATSYYWVHWGPGTLVTVSSAST KGPSVFPLAPSSKSTSGGTAALGCLVKDYFPE PVTVSWNSGALTSGVHTFPAVLQSSGLYSLS SVVTVPSSSLGTQTYICNVNHKPSNTKVDKK VEPKSCDKTHTCPPCPAPPVAGPDVFLFPPKP KDTLMISRTPEVTCVVVDVSHEDPEVKFNWY VDGVEVHNAKTKPREEQYNSTYRVVSVLTV LHQDWLNGKEYKCKVSNAALPAPIAKTISKA KGQPREPQVYTLPPSRDELTKNQVSLTCLVK GFYPSDIAVEWESNGQPENNYKTTPPVLDSD GSFFLYSKLTVDKSRWQQGNVFSCSVMHEA LHNRFTQKSLSLSPGKGGGGSGGGGSGGGGS GGGGSMLPAPKNLVVSRVTEDSARLSWTAP DAAFDSFHIEYAEPWVWGEAIVLTVPGSERS YDLTGLKPGTEYVVFIGGVKGGHNSTPLSAIF TTGGGGSGGGGSMLPAPKNLVVSRVTEDSA RLSWTAPDAAFDSFWITYEEKFYRGEAIVLT VPGSERSYDLTGLKPGTEYKVWIVGVKGGQ GSWPLSAIFTT |
| 954 | PRT | Human | CR-5133HC184 | EVQLVETGGGLVKPGGSLRLSCSASRFSFRD YYMTWIRQAPGKGPEWVSHISGSGSTIYYAD SVRGRFTISRDNAKSSLYLQMDSLQADDTAV YYCARGGRATSYYWVHWGPGTLVTVSSAST KGPSVFPLAPSSKSTSGGTAALGCLVKDYFPE PVTVSWNSGALTSGVHTFPAVLQSSGLYSLS SVVTVPSSSLGTQTYICNVNHKPSNTKVDKK VEPKSCDKTHTCPPCPAPPVAGPDVFLFPPKP KDTLMISRTPEVTCVVVDVSHEDPEVKFNWY VDGVEVHNAKTKPREEQYNSTYRVVSVLTV LHQDWLNGKEYKCKVSNAALPAPIAKTISKA KGQPREPQVYTLPPSRDELTKNQVSLTCLVK GFYPSDIAVEWESNGQPENNYKTTPPVLDSD GSFFLYSKLTVDKSRWQQGNVFSCSVMHEA LHNRFTQKSLSLSPGKGGGGSGGGGSGGGGS GGGGSMLPAPKNLVVSRVTEDSARLSWTAP DAAFDSFHIEYAEPWVWGEAIVLTVPGSERS YDLTGLKPGTEYVVFIGGVKGGHNSTPLSAIF TTGGGGSGGGGSGGGGSMLPAPKNLVVSRV TEDSARLSWTAPDAAFDSFWITYEEKFYRGE AIVLTVPGSERSYDLTGLKPGTEYKVWIVGV KGGQGSWPLSAIFTT |
| 955 | PRT | Human | CR-5133HC185 | EVQLVETGGGLVKPGGSLRLSCSASRFSFRD YYMTWIRQAPGKGPEWVSHISGSGSTIYYAD SVRGRFTISRDNAKSSLYLQMDSLQADDTAV YYCARGGRATSYYWVHWGPGTLVTVSSAST KGPSVFPLAPSSKSTSGGTAALGCLVKDYFPE |

TABLE 6-continued

Nucleic Acid and Amino Acid Sequences of the Disclosure

| SEQ ID NO: | Type | Species | Description | Sequence |
|---|---|---|---|---|
| | | | | PVTVSWNSGALTSGVHTFPAVLQSSGLYSLS SVVTVPSSSLGTQTYICNVNHKPSNTKVDKK VEPKSCDKTHTCPPCPAPPVAGPDVFLFPPKP KDTLMISRTPEVTCVVVDVSHEDPEVKFNWY VDGVEVHNAKTKPREEQYNSTYRVVSVLTV LHQDWLNGKEYKCKVSNAALPAPIAKTISKA KGQPREPQVYTLPPSRDELTKNQVSLTCLVK GFYPSDIAVEWESNGQPENNYKTTPPVLDSD GSFFLYSKLTVDKSRWQQGNVFSCSVMHEA LHNRFTQKSLSLSPGGGGSGGGGSGGGGSG GGGSMLPAPKNLVVSRVTEDSARLSWTAPD AAFDSFPIVYQEWQFYGEAIVLTVPGSERSYD LTGLKPGTEYLVDIYGVKGGSWSYPLSAIFTT GGGGSGGGGSGGGGSGGGGSMLPAPKNLVV SRVTEDSARLSWTAPDAAFDSFWITYEEKFY RGEAIVLTVPGSERSYDLTGLKPGTEYKVWI VGVKGGQGSWPLSAIFTT |
| 956 | PRT | Human | CR-5133HC186 | EVQLVETGGGLVKPGGSLRLSCSASRFSFRD YYMTWIRQAPGKGPEWVSHISGSGSTIYYAD SVRGRFTISRDNAKSSLYLQMDSLQADDTAV YYCARGGRATSYYWHWGPGTLVTVSSAST KGPSVFPLAPSSKSTSGGTAALGCLVKDYFPE PVTVSWNSGALTSGVHTFPAVLQSSGLYSLS SVVTVPSSSLGTQTYICNVNHKPSNTKVDKK VEPKSCDKTHTCPPCPAPPVAGPDVFLFPPKP KDTLMISRTPEVTCVVVDVSHEDPEVKFNWY VDGVEVHNAKTKPREEQYNSTYRVVSVLTV LHQDWLNGKEYKCKVSNAALPAPIAKTISKA KGQPREPQVYTLPPSRDELTKNQVSLTCLVK GFYPSDIAVEWESNGQPENNYKTTPPVLDSD GSFFLYSKLTVDKSRWQQGNVFSCSVMHEA LHNHYTQKSLSLSPGGGGSGGGGSGGGGS GGGGSMLPAPKNLVVSRVTEDSARLSWTAP DAAFDSFPIVYQEWQFYGEAIVLTVPGSERSY DLTGLKPGTEYLVDIYGVKGGSWSYPLSAIFT TGGGGSGGGGSGGGGSGGGGSMLPAPKNLV VSRVTEDSARLSWTAPDAAFDSFWITYEEKF YRGEAIVLTVPGSERSYDLTGLKPGTEYKVW IVGVKGGQGSWPLSAIFTT |
| 957 | PRT | Human | RSVHC187 | QITLKESGPTLVKPTQTLTLTCTFSGFSLSTSG MGVSWIRQPPGKALEWLAHIYWDDDKRYNP SLKSRLTITKDTSKNQVVLTMTNMDPVDTAT YYCARLYGFTYGFAYWGQGTLVTVSSASTK GPSVFPLAPSSKSTSGGTAALGCLVKDYFPEP VTVSWNSGALTSGVHTFPAVLQSSGLYSLSS VVTVPSSSLGTQTYICNVNHKPSNTKVDKKV EPKSCDKTHTCPPCPAPPVAGPDVFLFPPKPK DTLMISRTPEVTCVVVDVSHEDPEVKFNWYV DGVEVHNAKTKPREEQYNSTYRVVSVLTVL HQDWLNGKEYKCKVSNAALPAPIAKTISKAK GQPREPQVYTLPPSRDELTKNQVSLTCLVKG FYPSDIAVEWESNGQPENNYKTTPPVLDSDG SFFLYSKLTVDKSRWQQGNVFSCSVMHEAL HNHYTQKSLSLSPGKGGGGSGGGGSGGGGS GGGGSLPAPKNLVVSRVTEDSARLSWTAPDA AFDSFLIQYQESEKVGEAIVLTVPGSERSYDL TGLKPGTEYTVSIYGVKGGHRSNPLSAIFTTG GGGSGGGGSGGGGSGGGGSLPAPKNLVVSR VTEDSARLSWTAPDAAFDSFLIQYQESEKVG EAIVLTVPGSERSYDLTGLKPGTEYTVSIYGV KGGHRSNPLSAIFTT |
| 958 | PRT | Human | RSVHC188 | QITLKESGPTLVKPTQTLTLTCTFSGFSLSTSG MGVSWIRQPPGKALEWLAHIYWDDDKRYNP SLKSRLTITKDTSKNQVVLTMTNMDPVDTAT YYCARLYGFTYGFAYWGQGTLVTVSSASTK GPSVFPLAPSSKSTSGGTAALGCLVKDYFPEP VTVSWNSGALTSGVHTFPAVLQSSGLYSLSS VVTVPSSSLGTQTYICNVNHKPSNTKVDKKV EPKSCDKTHTCPPCPAPPVAGPDVFLFPPKPK DTLMISRTPEVTCVVVDVSHEDPEVKFNWYV DGVEVHNAKTKPREEQYNSTYRVVSVLTVL HQDWLNGKEYKCKVSNAALPAPIAKTISKAK |

TABLE 6-continued

Nucleic Acid and Amino Acid Sequences of the Disclosure

| SEQ ID NO: | Type | Species | Description | Sequence |
|---|---|---|---|---|
| | | | | GQPREPQVYTLPPSRDELTKNQVSLTCLVKG
FYPSDIAVEWESNGQPENNYKTTPPVLDSDG
SFFLYSKLTVDKSRWQQGNVFSCSVMHEAL
HNHYTQKSLSLSPGKGGGGSGGGGSGGGGS
GGGGSMLPAPKNLVVSRVTEDSARLSWTAP
DAAFDSFLIQYQESEKVGEAIVLTVPGSERSY
DLTGLKPGTEYTVSIYGVKGGHRSNPLSAIFT
TGGGGSGGGGSGGGGSGGGGSMLPAPKNLV
VSRVTEDSARLSWTAPDAAFDSFLIQYQESE
KVGEAIVLTVPGSERSYDLTGLKPGTEYTVSI
YGVKGGHRSNPLSAIFTT |
| 959 | PRT | Human | RSVHC189 | QITLKESGPTLVKPTQTLTLTCTFSGFSLSTSG
MGVSWIRQPPGKALEWLAHIYWDDDKRYNP
SLKSRLTITKDTSKNQVVLTMTNMDPVDTAT
YYCARLYGFTYGFAYWGQGTLVTVSSASTK
GPSVFPLAPSSKSTSGGTAALGCLVKDYFPEP
VTVSWNSGALTSGVHTFPAVLQSSGLYSLSS
VVTVPSSSLGTQTYICNVNHKPSNTKVDKKV
EPKSCDKTHTCPPCPAPELLGGPSVFLFPPKP
KDTLMISRTPEVTCVVVDVSHEDPEVKFNWY
VDGVEVHNAKTKPREEQYNSTYRVVSVLTV
LHQDWLNGKEYKCKVSNKALPAPIEKTISKA
KGQPREPQVYTLPPSRDELTKNQVSLTCLVK
GFYPSDIAVEWESNGQPENNYKTTPPVLDSD
GSFFLYSKLTVDKSRWQQGNVFSCSVMHEA
LHNHYTQKSLSLSPGKGGGGSGGGGSGGGG
SGGGGSLPAPKNLVVSRVTEDSARLSWTAPD
AAFDSFLIQYQESEKVGEAIVLTVPGSERSYD
LTGLKPGTEYTVSIYGVKGGHRSNPLSAIFTT
GGGGSGGGGSGGGGSGGGGSLPAPKNLVVS
RVTEDSARLSWTAPDAAFDSFLIQYQESEKV
GEAIVLTVPGSERSYDLTGLKPGTEYTVSIYG
VKGGHRSNPLSAIFTT |
| 960 | PRT | Human | RSVHC190 | QITLKESGPTLVKPTQTLTLTCTFSGFSLSTSG
MGVSWIRQPPGKALEWLAHIYWDDDKRYNP
SLKSRLTITKDTSKNQVVLTMTNMDPVDTAT
YYCARLYGFTYGFAYWGQGTLVTVSSASTK
GPSVFPLAPSSKSTSGGTAALGCLVKDYFPEP
VTVSWNSGALTSGVHTFPAVLQSSGLYSLSS
VVTVPSSSLGTQTYICNVNHKPSNTKVDKKV
EPKSCDKTHTCPPCPAPELLGGPSVFLFPPKP
KDTLMISRTPEVTCVVVDVSHEDPEVKFNWY
VDGVEVHNAKTKPREEQYNSTYRVVSVLTV
LHQDWLNGKEYKCKVSNKALPAPIEKTISKA
KGQPREPQVYTLPPSRDELTKNQVSLTCLVK
GFYPSDIAVEWESNGQPENNYKTTPPVLDSD
GSFFLYSKLTVDKSRWQQGNVFSCSVMHEA
LHNHYTQKSLSLSPGKGGGGSGGGGSGGGG
SGGGGSMLPAPKNLVVSRVTEDSARLSWTAP
DAAFDSFLIQYQESEKVGEAIVLTVPGSERSY
DLTGLKPGTEYTVSIYGVKGGHRSNPLSAIFT
TGGGGSGGGGSGGGGSGGGGSMLPAPKNLV
VSRVTEDSARLSWTAPDAAFDSFLIQYQESE
KVGEAIVLTVPGSERSYDLTGLKPGTEYTVSI
YGVKGGHRSNPLSAIFTT |
| 961 | PRT | Human | CR-5133HC200 | EVQLVETGGGLVKPGGSLRLSCSASRFSFRD
YYMTWIRQAPGKGPEWVSHISGSGSTIYYAD
SVRGRFTISRDNAKSSLYLQMDSLQADDTAV
YYCARGGRATSYYWVHWGPGTLVTVSSAST
KGPSVFPLAPSSKSTSGGTAALGCLVKDYFPE
PVTVSWNSGALTSGVHTFPAVLQSSGLYSLS
SVVTVPSSSLGTQTYICNVNHKPSNTKVDKK
VEPKSCDKTHTCPPCPAPELLGGPSVFLFPPK
PKDTLMISRTPEVTCVVVDVSHEDPEVKFNW
YVDGVEVHNAKTKPREEQYNSTYRVVSVLT
VLHQDWLNGKEYKCKVSNKALPAPIEKTISK
AKGQPREPQVYTLPPSRDELTKNQVSLTCLV
KGFYPSDIAVEWESNGQPENNYKTTPPVLDS
DGSFFLYSKLTVDKSRWQQGNVFSCSVMHE
ALHNRFTQKSLSLSPGKGGGGSGGGGSGGG
GSGGGGSMLPAPKNLVVSRVTEDSARLSWT
APDAAFDSFHIEYAEPWVWGEAIVLTVPGSE |

TABLE 6-continued

Nucleic Acid and Amino Acid Sequences of the Disclosure

| SEQ ID NO: | Type | Species | Description | Sequence |
|---|---|---|---|---|
| | | | | RSYDLTGLKPGTEYVVFIGGVKGGHNSTPLS AIFTTGGGSGGGGSGGGGSGGGGSMLPAPK NLVVSRVTEDSARLSWTAPDAAFDSFWITYE EKFYRGEAIVLTVPGSERSYDLTGLKPGTEYK VWIVGVKGGQGSWPLSAIFTT |
| 962 | PRT | Human | CR-5133HC201 | EVQLVETGGGLVKPGGSLRLSCSASRFSFRD YYMTWIRQAPGKGPEWVSHISGSGSTIYYAD SVRGRFTISRDNAKSSLYLQMDSLQADDTAV YYCARGGRATSYYWVHWGPGTLVTVSSAST KGPSVFPLAPSSKSTSGGTAALGCLVKDYFPE PVTVSWNSGALTSGVHTFPAVLQSSGLYSLS SVVTVPSSSLGTQTYICNVNHKPSNTKVDKK VEPKSCDKTHTCPPCPAPELLGGPSVFLFPPK PKDTLMISRTPEVTCVVVDVSHEDPEVKFNW YVDGVEVHNAKTKPREEQYNSTYRVVSVLT VLHQDWLNGKEYKCKVSNKALPAPIEKTISK AKGQPREPQVYTLPPSRDELTKNQVSLTCLV KGFYPSDIAVEWESNGQPENNYKTTPPVLDS DGSFFLYSKLTVDKSRWQQGNVFSCSVMHE ALHNHYTQKSLSLSPGKGGGGSGGGGSGGG GSGGGGSMLPAPKNLVVSRVTEDSARLSWT APDAAFDSFHIEYAEPWVWGEAIVLTVPGSE RSYDLTGLKPGTEYVVFIGGVKGGHNSTPLS AIFTTGGGSGGGGSGGGGSGGGGSMLPAPK NLVVSRVTEDSARLSWTAPDAAFDSFWITYE EKFYRGEAIVLTVPGSERSYDLTGLKPGTEYK VWIVGVKGGQGSWPLSAIFTT |
| 963 | PRT | Human | CR-5133HC212 | EVQLVETGGGLVKPGGSLRLSCSASRFSFRD YYMTWIRQAPGKGPEWVSHISGSGSTIYYAD SVRGRFTISRDNAKSSLYLQMDSLQADDTAV YYCARGGRATSYYWVHWGPGTLVTVSSAST KGPSVFPLAPSSKSTSGGTAALGCLVKDYFPE PVTVSWNSGALTSGVHTFPAVLQSSGLYSLS SVVTVPSSSLGTQTYICNVNHKPSNTKVDKK VEPKSCDKTHTCPPCPAPPVAGPDVFLFPPKP KDTLMISRTPEVTCVVVDVSHEDPEVKFNWY VDGVEVHNAKTKPREEQYNSTYRVVSVLTV LHQDWLNGKEYKCKVSNAALPAPIAKTISKA KGQPREPQVYTLPPSRDELTKNQVSLTCLVK GFYPSDIAVEWESNGQPENNYKTTPPVLDSD GSFFLYSKLTVDKSRWQQGNVFSCSVMHEA LHNHYTQKSLSLSPGKGGGGSGGGGSGGGG SGGGGSMLPAPKNLVVSRVTEDSARLSWTAP DAAFDSFHIEYAEPWVWGEAIVLTVPGSERS YDLTGLKPGTEYVVFIGGVKGGHNSTPLSAIF TTGGGGSMLPAPKNLVVSRVTEDSARLSWT APDAAFDSFWITYEEKFYRGEAIVLTVPGSER SYDLTGLKPGTEYKVWIVGVKGGQGSWPLS AIFTT |
| 964 | PRT | Human | CR-5133HC230 | EQKLISEEDLEVQLVETGGGLVKPGGSLRLSC SASRFSFRDYYMTWIRQAPGKGPEWVSHISG SGSTIYYADSVRGRFTISRDNAKSSLYLQMDS LQADDTAVYYCARGGRATSYYWVHWGPGT LVTVSSASTKGPSVFPLAPSSKSTSGGTAALG CLVKDYFPEPVTVSWNSGALTSGVHTFPAVL QSSGLYSLSSVVTVPSSSLGTQTYICNVNHKP SNTKVDKKVEPKSCDKTHTCPPCPAPPVAGP DVFLFPPKPKDTLMISRTPEVTCVVVDVSHED PEVKFNWYVDGVEVHNAKTKPREEQYNSTY RVVSVLTVLHQDWLNGKEYKCKVSNAALPA PIAKTISKAKGQPREPQVYTLPPSRDELTKNQ VSLTCLVKGFYPSDIAVEWESNGQPENNYKT TPPVLDSDGSFFLYSKLTVDKSRWQQGNVFS CSVMHEALHNHYTQKSLSLSPGKGGGGSGG GGSGGGGSGGGGSMLPAPKNLVVSRVTEDS ARLSWTAPDAAFDSFHIEYAEPWVWGEAIVL TVPGSERSYDLTGLKPGTEYVVFIGGVKGGH NSTPLSAIFTTGGGGSMLPAPKNLVVSRVTED SARLSWTAPDAAFDSFWITYEEKFYRGEAIV LTVPGSERSYDLTGLKPGTEYKVWIVGVKGG QGSWPLSAIFTT |

TABLE 6-continued

Nucleic Acid and Amino Acid Sequences of the Disclosure

| SEQ ID NO: | Type | Species | Description | Sequence |
|---|---|---|---|---|
| 965 | PRT | Human | CR-5133HC231 | EVQLVETGGGLVKPGGSLRLSCSASRFSFRD YYMTWIRQAPGKGPEWVSHISGSGSTIYYAD SVRGRFTISRDNAKSSLYLQMDSLQADDTAV YYCARGGRATSYYWVHWGPGTLVTVSSAST KGPSVFPLAPSSKSTSGGTAALGCLVKDYFPE PVTVSWNSGALTSGVHTFPAVLQSSGLYSLS SVVTVPSSSLGTQTYICNVNHKPSNTKVDKK VEPKSCDKTHTCPPCPAPPVAGPDVFLFPPKP KDTLMISRTPEVTCVVVDVSHEDPEVKFNWY VDGVEVHNAKTKPREEQYNSTYRVVSVLTV LHQDWLNGKEYKCKVSNAALPAPIAKTISKA KGQPREPQVYTLPPSRDELTKNQVSLTCLVK GFYPSDIAVEWESNGQPENNYKTTPPVLDSD GSFFLYSKLTVDKSRWQQGNVFSCSVMHEA LHNHYTQKSLSLSPGKGGGGSGGGGSGGGG SGGGGSMLPAPKNLVVSRVTEDSARLSWTAP DAAFDSFHIEYAEPWVWGEAIVLTVPGSERS YDLTGLKPGTEYVVFIGGVKGGHNSTPLSAIF TTGGGGSMLPAPKNLVVSRVTEDSARLSWT APDAAFDSFWITYEEKFYRGEAIVLTVPGSER SYDLTGLKPGTEYKVWIVGVKGGQGSWPLS AIFTTDYKDDDDK |
| 966 | PRT | Human | CR-5133HC232 | EQKLISEEDLEVQLVETGGGLVKPGGSLRLSC SASRFSFRDYYMTWIRQAPGKGPEWVSHISG SGSTIYYADSVRGRFTISRDNAKSSLYLQMDS LQADDTAVYYCARGGRATSYYWVHWGPGT LVTVSSASTKGPSVFPLAPSSKSTSGGTAALG CLVKDYFPEPVTVSWNSGALTSGVHTFPAVL QSSGLYSLSSVVTVPSSSLGTQTYICNVNHKP SNTKVDKKVEPKSCDKTHTCPPCPAPPVAGP DVFLFPPKPKDTLMISRTPEVTCVVVDVSHED PEVKFNWYVDGVEVHNAKTKPREEQYNSTY RVVSVLTVLHQDWLNGKEYKCKVSNAALPA PIAKTISKAKGQPREPQVYTLPPSRDELTKNQ VSLTCLVKGFYPSDIAVEWESNGQPENNYKT TPPVLDSDGSFFLYSKLTVDKSRWQQGNVFS CSVMHEALHNHYTQKSLSLSPGKGGGGSGG GGSGGGGSGGGGSMLPAPKNLVVSRVTEDS ARLSWTAPDAAFDSFHIEYAEPWVWGEAIVL TVPGSERSYDLTGLKPGTEYVVFIGGVKGGH NSTPLSAIFTTGGGGSMLPAPKNLVVSRVTED SARLSWTAPDAAFDSFWITYEEKFYRGEAIV LTVPGSERSYDLTGLKPGTEYKVWIVGVKGG QGSWPLSAIFTTDYKDDDDK |
| 967 | PRT | Human | CR-5133HC233 | EQKLISEEDLEVQLVETGGGLVKPGGSLRLSC SASRFSFRDYYMTWIRQAPGKGPEWVSHISG SGSTIYYADSVRGRFTISRDNAKSSLYLQMDS LQADDTAVYYCARGGRATSYYWVHWGPGT LVTVSSASTKGPSVFPLAPSSKSTSGGTAALG CLVKDYFPEPVTVSWNSGALTSGVHTFPAVL QSSGLYSLSSVVTVPSSSLGTQTYICNVNHKP SNTKVDKKVEPKSCDKTHTCPPCPAPPVAGP DVFLFPPKPKDTLMISRTPEVTCVVVDVSHED PEVKFNWYVDGVEVHNAKTKPREEQYNSTY RVVSVLTVLHQDWLNGKEYKCKVSNAALPA PIAKTISKAKGQPREPQVYTLPPSRDELTKNQ VSLTCLVKGFYPSDIAVEWESNGQPENNYKT TPPVLDSDGSFFLYSKLTVDKSRWQQGNVFS CSVMHEALHNRFTQKSLSLSPGKGGGGSGG GGSGGGGSGGGGSMLPAPKNLVVSRVTEDS ARLSWTAPDAAFDSFHIEYAEPWVWGEAIVL TVPGSERSYDLTGLKPGTEYVVFIGGVKGGH NSTPLSAIFTTGGGGSMLPAPKNLVVSRVTED SARLSWTAPDAAFDSFWITYEEKFYRGEAIV LTVPGSERSYDLTGLKPGTEYKVWIVGVKGG QGSWPLSAIFTT |
| 968 | PRT | Human | CR-5133HC234 | EVQLVETGGGLVKPGGSLRLSCSASRFSFRD YYMTWIRQAPGKGPEWVSHISGSGSTIYYAD SVRGRFTISRDNAKSSLYLQMDSLQADDTAV YYCARGGRATSYYWVHWGPGTLVTVSSAST KGPSVFPLAPSSKSTSGGTAALGCLVKDYFPE PVTVSWNSGALTSGVHTFPAVLQSSGLYSLS |

TABLE 6-continued

Nucleic Acid and Amino Acid Sequences of the Disclosure

| SEQ ID NO: | Type | Species | Description | Sequence |
|---|---|---|---|---|
| | | | | SVVTVPSSSLGTQTYICNVNHKPSNTKVDKK VEPKSCDKTHTCPPCPAPPVAGPDVFLFPPKP KDTLMISRTPEVTCVVVDVSHEDPEVKFNWY VDGVEVHNAKTKPREEQYNSTYRVVSVLTV LHQDWLNGKEYKCKVSNAALPAPIAKTISKA KGQPREPQVYTLPPSRDELTKNQVSLTCLVK GFYPSDIAVEWESNGQPENNYKTTPPVLDSD GSFFLYSKLTVDKSRWQQGNVFSCSVMHEA LHNRFTQKSLSLSPGKGGGGSGGGGSGGGGS GGGGSMLPAPKNLVVSRVTEDSARLSWTAP DAAFDSFHIEYAEPWVWGEAIVLTVPGSERS YDLTGLKPGTEYVVFIGGVKGGHNSTPLSAIF TTGGGGSMLPAPKNLVVSRVTEDSARLSWT APDAAFDSFWITYEEKFYRGEAIVLTVPGSER SYDLTGLKPGTEYKVWIVGVKGGQGSWPLS AIFTTDYKDDDDK |
| 969 | PRT | Human | CR-5133HC235 | EQKLISEEDLEVQLVETGGGLVKPGGSLRLSC SASRFSFRDYYMTWIRQAPGKGPEWVSHISG SGSTIYYADSVRGRFTISRDNAKSSLYLQMDS LQADDTAVYYCARGGRATSYYWVHWGPGT LVTVSSASTKGPSVFPLAPSSKSTSGGTAALG CLVKDYFPEPVTVSWNSGALTSGVHTFPAVL QSSGLYSLSSVVTVPSSSLGTQTYICNVNHKP SNTKVDKKVEPKSCDKTHTCPPCPAPPVAGP DVFLFPPKPKDTLMISRTPEVTCVVVDVSHED PEVKFNWYVDGVEVHNAKTKPREEQYNSTY RVVSVLTVLHQDWLNGKEYKCKVSNAALPA PIAKTISKAKGQPREPQVYTLPPSRDELTKNQ VSLTCLVKGFYPSDIAVEWESNGQPENNYKT TPPVLDSDGSFFLYSKLTVDKSRWQQGNVFS CSVMHEALHNHYTQKSLSLSPGKGGGGSGG GGSGGGGSGGGGSMLPAPKNLVVSRVTEDS ARLSWTAPDAAFDSFHIEYAEPWVWGEAIVL TVPGSERSYDLTGLKPGTEYVVFIGGVKGGH NSTPLSAIFTTGGGGSGGGGSGGGGSGGGGS MLPAPKNLVVSRVTEDSARLSWTAPDAAFDS FWITYEEKFYRGEAIVLTVPGSERSYDLTGLK PGTEYKVWIVGVKGGQGSWPLSAIFTT |
| 970 | PRT | Human | CR-5133HC236 | EVQLVETGGGLVKPGGSLRLSCSASRFSFRD YYMTWIRQAPGKGPEWVSHISGSGSTIYYAD SVRGRFTISRDNAKSSLYLQMDSLQADDTAV YYCARGGRATSYYWVHWGPGTLVTVSSAST KGPSVFPLAPSSKSTSGGTAALGCLVKDYFPE PVTVSWNSGALTSGVHTFPAVLQSSGLYSLS SVVTVPSSSLGTQTYICNVNHKPSNTKVDKK VEPKSCDKTHTCPPCPAPPVAGPDVFLFPPKP KDTLMISRTPEVTCVVVDVSHEDPEVKFNWY VDGVEVHNAKTKPREEQYNSTYRVVSVLTV LHQDWLNGKEYKCKVSNAALPAPIAKTISKA KGQPREPQVYTLPPSRDELTKNQVSLTCLVK GFYPSDIAVEWESNGQPENNYKTTPPVLDSD GSFFLYSKLTVDKSRWQQGNVFSCSVMHEA LHNHYTQKSLSLSPGKGGGGSGGGGSGGGG SGGGGSMLPAPKNLVVSRVTEDSARLSWTAP DAAFDSFHIEYAEPWVWGEAIVLTVPGSERS YDLTGLKPGTEYVVFIGGVKGGHNSTPLSAIF TTGGGGSGGGGSGGGGSGGGGSMLPAPKNL VVSRVTEDSARLSWTAPDAAFDSFWITYEEK FYRGEAIVLTVPGSERSYDLTGLKPGTEYKV WIVGVKGGQGSWPLSAIFTTDYKDDDDK |
| 971 | PRT | Human | CR-5133HC237 | EQKLISEEDLEVQLVETGGGLVKPGGSLRLSC SASRFSFRDYYMTWIRQAPGKGPEWVSHISG SGSTIYYADSVRGRFTISRDNAKSSLYLQMDS LQADDTAVYYCARGGRATSYYWVHWGPGT LVTVSSASTKGPSVFPLAPSSKSTSGGTAALG CLVKDYFPEPVTVSWNSGALTSGVHTFPAVL QSSGLYSLSSVVTVPSSSLGTQTYICNVNHKP SNTKVDKKVEPKSCDKTHTCPPCPAPPVAGP DVFLFPPKPKDTLMISRTPEVTCVVVDVSHED PEVKFNWYVDGVEVHNAKTKPREEQYNSTY RVVSVLTVLHQDWLNGKEYKCKVSNAALPA PIAKTISKAKGQPREPQVYTLPPSRDELTKNQ |

TABLE 6-continued

Nucleic Acid and Amino Acid Sequences of the Disclosure

| SEQ ID NO: | Type | Species | Description | Sequence |
|---|---|---|---|---|
| | | | | VSLTCLVKGFYPSDIAVEWESNGQPENNYKT
TPPVLDSDGSFFLYSKLTVDKSRWQQGNVFS
CSVMHEALHNHYTQKSLSLSPGKGGGGSGG
GGSGGGGSGGGGSMLPAPKNLVVSRVTEDS
ARLSWTAPDAAFDSFHIEYAEPWVWGEAIVL
TVPGSERSYDLTGLKPGTEYVVFIGGVKGGH
NSTPLSAIFTTGGGGSGGGGSGGGGSGGGGS
MLPAPKNLVVSRVTEDSARLSWTAPDAAFDS
FWITYEEKFYRGEAIVLTVPGSERSYDLTGLK
PGTEYKVWIVGVKGGQGSWPLSAIFTTDYKD
DDDK |
| 972 | PRT | Human | CR-5133HC238 | EQKLISEEDLEVQLVETGGGLVKPGGSLRLSC
SASRFSFRDYYMTWIRQAPGKGPEWVSHISG
SGSTIYYADSVRGRFTISRDNAKSSLYLQMDS
LQADDTAVYYCARGGRATSYYWVHWGPGT
LVTVSSASTKGPSVFPLAPSSKSTSGGTAALG
CLVKDYFPEPVTVSWNSGALTSGVHTFPAVL
QSSGLYSLSSVVTVPSSSLGTQTYICNVNHKP
SNTKVDKKVEPKSCDKTHTCPPCPAPPVAGP
DVFLFPPKPKDTLMISRTPEVTCVVVDVSHED
PEVKFNWYVDGVEVHNAKTKPREEQYNSTY
RVVSVLTVLHQDWLNGKEYKCKVSNAALPA
PIAKTISKAKGQPREPQVYTLPPSRDELTKNQ
VSLTCLVKGFYPSDIAVEWESNGQPENNYKT
TPPVLDSDGSFFLYSKLTVDKSRWQQGNVFS
CSVMHEALHNRFTQKSLSLSPGKGGGGSGG
GGSGGGGSGGGGSMLPAPKNLVVSRVTEDS
ARLSWTAPDAAFDSFHIEYAEPWVWGEAIVL
TVPGSERSYDLTGLKPGTEYVVFIGGVKGGH
NSTPLSAIFTTGGGGSMLPAPKNLVVSRVTED
SARLSWTAPDAAFDSFWITYEEKFYRGEAIV
LTVPGSERSYDLTGLKPGTEYKVWIVGVKGG
QGSWPLSAIFTTDYKDDDDK |
| 973 | PRT | Human | CR-5133HC239 | DYKDDDDKEVQLVETGGGLVKPGGSLRLSC
SASRFSFRDYYMTWIRQAPGKGPEWVSHISG
SGSTIYYADSVRGRFTISRDNAKSSLYLQMDS
LQADDTAVYYCARGGRATSYYWVHWGPGT
LVTVSSASTKGPSVFPLAPSSKSTSGGTAALG
CLVKDYFPEPVTVSWNSGALTSGVHTFPAVL
QSSGLYSLSSVVTVPSSSLGTQTYICNVNHKP
SNTKVDKKVEPKSCDKTHTCPPCPAPPVAGP
DVFLFPPKPKDTLMISRTPEVTCVVVDVSHED
PEVKFNWYVDGVEVHNAKTKPREEQYNSTY
RVVSVLTVLHQDWLNGKEYKCKVSNAALPA
PIAKTISKAKGQPREPQVYTLPPSRDELTKNQ
VSLTCLVKGFYPSDIAVEWESNGQPENNYKT
TPPVLDSDGSFFLYSKLTVDKSRWQQGNVFS
CSVMHEALHNRFTQKSLSLSPGKGGGGSGG
GGSGGGGSGGGGSMLPAPKNLVVSRVTEDS
ARLSWTAPDAAFDSFHIEYAEPWVWGEAIVL
TVPGSERSYDLTGLKPGTEYVVFIGGVKGGH
NSTPLSAIFTTGGGGSGGGGSGGGGSGGGGS
MLPAPKNLVVSRVTEDSARLSWTAPDAAFDS
FWITYEEKFYRGEAIVLTVPGSERSYDLTGLK
PGTEYKVWIVGVKGGQGSWPLSAIFTT |
| 974 | PRT | Human | CR-5133HC240 | DYKDDDDKEVQLVETGGGLVKPGGSLRLSC
SASRFSFRDYYMTWIRQAPGKGPEWVSHISG
SGSTIYYADSVRGRFTISRDNAKSSLYLQMDS
LQADDTAVYYCARGGRATSYYWVHWGPGT
LVTVSSASTKGPSVFPLAPSSKSTSGGTAALG
CLVKDYFPEPVTVSWNSGALTSGVHTFPAVL
QSSGLYSLSSVVTVPSSSLGTQTYICNVNHKP
SNTKVDKKVEPKSCDKTHTCPPCPAPPVAGP
DVFLFPPKPKDTLMISRTPEVTCVVVDVSHED
PEVKFNWYVDGVEVHNAKTKPREEQYNSTY
RVVSVLTVLHQDWLNGKEYKCKVSNAALPA
PIAKTISKAKGQPREPQVYTLPPSRDELTKNQ
VSLTCLVKGFYPSDIAVEWESNGQPENNYKT
TPPVLDSDGSFFLYSKLTVDKSRWQQGNVFS
CSVMHEALHNHYTQKSLSLSPGKGGGGSGG
GGSGGGGSGGGGSMLPAPKNLVVSRVTEDS
ARLSWTAPDAAFDSFHIEYAEPWVWGEAIVL |

TABLE 6-continued

Nucleic Acid and Amino Acid Sequences of the Disclosure

| SEQ ID NO: | Type | Species | Description | Sequence |
|---|---|---|---|---|
| | | | | TVPGSERSYDLTGLKPGTEYVVFIGGVKGGH NSTPLSAIFTTGGGSGGGGSGGGGSGGGGS MLPAPKNLVVSRVTEDSARLSWTAPDAAFDS FWITYEEKFYRGEAIVLTVPGSERSYDLTGLK PGTEYKVWIVGVKGGQGSWPLSAIFTT |
| 975 | PRT | Human | CR-5133HC241 | DYKDDDDKEVQLVETGGGLVKPGGSLRLSC SASRFSFRDYYMTWIRQAPGKGPEWVSHISG SGSTIYYADSVRGRFTISRDNAKSSLYLQMDS LQADDTAVYYCARGGRATSYYWVHWGPGT LVTVSSASTKGPSVFPLAPSSKSTSGGTAALG CLVKDYFPEPVTVSWNSGALTSGVHTFPAVL QSSGLYSLSSVVTVPSSSLGTQTYICNVNHKP SNTKVDKKVEPKSCDKTHTCPPCPAPPVAGP DVFLFPPKPKDTLMISRTPEVTCVVVDVSHED PEVKFNWYVDGVEVHNAKTKPREEQYNSTY RVVSVLTVLHQDWLNGKEYKCKVSNAALPA PIAKTISKAKGQPREPQVYTLPPSRDELTKNQ VSLTCLVKGFYPSDIAVEWESNGQPENNYKT TPPVLDSDGSFFLYSKLTVDKSRWQQGNVFS CSVMHEALHNRFTQKSLSLSPGKGGGGSGG GGSGGGGSGGGGSMLPAPKNLVVSRVTEDS ARLSWTAPDAAFDSFHIEYAEPWVWGEAIVL TVPGSERSYDLTGLKPGTEYVVFIGGVKGGH NSTPLSAIFTTGGGGSMLPAPKNLVVSRVTED SARLSWTAPDAAFDSFWITYEEKFYRGEAIV LTVPGSERSYDLTGLKPGTEYKVWIVGVKGG QGSWPLSAIFTT |
| 976 | PRT | Human | CR-5133HC242 | DYKDDDDKEVQLVETGGGLVKPGGSLRLSC SASRFSFRDYYMTWIRQAPGKGPEWVSHISG SGSTIYYADSVRGRFTISRDNAKSSLYLQMDS LQADDTAVYYCARGGRATSYYWVHWGPGT LVTVSSASTKGPSVFPLAPSSKSTSGGTAALG CLVKDYFPEPVTVSWNSGALTSGVHTFPAVL QSSGLYSLSSVVTVPSSSLGTQTYICNVNHKP SNTKVDKKVEPKSCDKTHTCPPCPAPPVAGP DVFLFPPKPKDTLMISRTPEVTCVVVDVSHED PEVKFNWYVDGVEVHNAKTKPREEQYNSTY RVVSVLTVLHQDWLNGKEYKCKVSNAALPA PIAKTISKAKGQPREPQVYTLPPSRDELTKNQ VSLTCLVKGFYPSDIAVEWESNGQPENNYKT TPPVLDSDGSFFLYSKLTVDKSRWQQGNVFS CSVMHEALHNHYTQKSLSLSPGKGGGGSGG GGSGGGGSGGGGSMLPAPKNLVVSRVTEDS ARLSWTAPDAAFDSFHIEYAEPWVWGEAIVL TVPGSERSYDLTGLKPGTEYVVFIGGVKGGH NSTPLSAIFTTGGGGSMLPAPKNLVVSRVTED SARLSWTAPDAAFDSFWITYEEKFYRGEAIV LTVPGSERSYDLTGLKPGTEYKVWIVGVKGG QGSWPLSAIFTT |
| 977 | PRT | Human | RSVHC65 | QITLKESGPTLVKPTQTLTLTCTFSGFSLSTSG MGVSWIRQPPGKALEWLAHIYWDDDKRYNP SLKSRLTITKDTSKNQVVLTMTNMDPVDTAT YYCARLYGFTYGFAYWGQGTLVTVSSASTK GPSVFPLAPSSKSTSGGTAALGCLVKDYFPEP VTVSWNSGALTSGVHTFPAVLQSSGLYSLSS VVTVPSSSLGTQTYICNVNHKPSNTKVDKKV EPKSCDKTHTCPPCPAPPVAGPDVFLFPPKPK DTLMISRTPEVTCVVVDVSHEDPEVKFNWYV DGVEVHNAKTKPREEQYNSTYRVVSVLTVL HQDWLNGKEYKCKVSNAALPAPIAKTISKAK GQPREPQVYTLPPSRDELTKNQVSLTCLVKG FYPSDIAVEWESNGQPENNYKTTPPVLDSDG SFFLYSKLTVDKSRWQQGNVFSCSVMHEAL HNRFTQKSLSLSPGKGGGGSGGGGSGGGGSG GGGSLPAPKNLVVSRVTEDSARLSWTAPDAA FDSFLIQYQESEKVGEAIVLTVPGSERSYDLT GLKPGTEYTVSIYGVKGGHRSNPLSAIFTT |
| 978 | PRT | Human | CR-5133LC290 | EIVLTQSPATLSLSPGERATLSCRASQSVSGYL GWYQQKPGQAPRLLIYGASSRATGIPDRFSG SGSGTDFTLTISRLEPEDFAVYYCQQYGSSPL TFGGGTKLEIKRTVAAPSVFIFPPSDEQLKSGT |

TABLE 6-continued

Nucleic Acid and Amino Acid Sequences of the Disclosure

| SEQ ID NO: | Type | Species | Description | Sequence |
|---|---|---|---|---|
| | | | | ASVVCLLNNFYPREAKVQWKVDNALQSGNS QESVTEQDSKDSTYSLSSTLTLSKADYEKHK VYACEVTHQGLSSPVTKSFNRGECGGGGSGG GGSGGGGSGGGGSMLPAPKNLVVSRVTEDS ARLSWTAPDAAFDSFLIQYQESEKVGEAIVLT VPGSERSYDLTGLKPGTEYTVSIYGVKGGHR SNPLSAIFTT |
| 979 | PRT | Human | CR-5133LC291 | EIVLTQSPATLSLSPGERATLSCRASQSVSGYL GWYQQKPGQAPRLLIYGASSRATGIPDRFSG SGSGTDFTLTISRLEPEDFAVYYCQQYGSSPL TFGGGTKLEIKRTVAAPSVFIFPPSDEQLKSGT ASVVCLLNNFYPREAKVQWKVDNALQSGNS QESVTEQDSKDSTYSLSSTLTLSKADYEKHK VYACEVTHQGLSSPVTKSFNRGECGGGGSGG GGSGGGGSGGGGSMLPAPKNLVVSRVTEDS ARLSWTAPDAAFDSFWITYEEKFYRGEAIVL TVPGSERSYDLTGLKPGTEYKVWIVGVKGG QGSWPLSAIFTT |
| 980 | PRT | Human | CR-5133LC292 | EIVLTQSPATLSLSPGERATLSCRASQSVSGYL GWYQQKPGQAPRLLIYGASSRATGIPDRFSG SGSGTDFTLTISRLEPEDFAVYYCQQYGSSPL TFGGGTKLEIKRTVAAPSVFIFPPSDEQLKSGT ASVVCLLNNFYPREAKVQWKVDNALQSGNS QESVTEQDSKDSTYSLSSTLTLSKADYEKHK VYACEVTHQGLSSPVTKSFNRGECGGGGSGG GGSGGGGSGGGGSMLPAPKNLVVSRVTEDS ARLSWTAPDAAFDSFHIEYAEPWVWGEAIVL TVPGSERSYDLTGLKPGTEYVVFIGGVKGGH NSTPLSAIFTT |
| 981 | PRT | Human | RSVLC343 | DIVMTQSPDSLAVSLGERATINCRASQSVDY NGISYMHWYQQKPGQPPKLLIYAASNPESGV PDRFSGSGSGTDFTLTISSLQAEDVAVYYCQQ IIEDPWTFGQGTKVEIKRTVAAPSVFIFPPSDE QLKSGTASVVCLLNNFYPREAKVQWKVDNA LQSGNSQESVTEQDSKDSTYSLSSTLTLSKAD YEKHKVYACEVTHQGLSSPVTKSFNRGECG GGGSGGGGSGGGGSGGGGSMLPAPKNLVVS RVTEDSARLSWTAPDAAFDSFLIQYQESEKV GEAIVLTVPGSERSYDLTGLKPGTEYTVSIYG VKGGHRSNPLSAIFTT |
| 982 | PRT | Human | RSVLC344 | DIVMTQSPDSLAVSLGERATINCRASQSVDY NGISYMHWYQQKPGQPPKLLIYAASNPESGV PDRFSGSGSGTDFTLTISSLQAEDVAVYYCQQ IIEDPWTFGQGTKVEIKRTVAAPSVFIFPPSDE QLKSGTASVVCLLNNFYPREAKVQWKVDNA LQSGNSQESVTEQDSKDSTYSLSSTLTLSKAD YEKHKVYACEVTHQGLSSPVTKSFNRGECG GGGSGGGGSGGGGSGGGGSMLPAPKNLVVS RVTEDSARLSWTAPDAAFDSFWITYEEKFYR GEAIVLTVPGSERSYDLTGLKPGTEYKVWIV GVKGGQGSWPLSAIFTT |
| 983 | PRT | Human | RSVLC345 | DIVMTQSPDSLAVSLGERATINCRASQSVDY NGISYMHWYQQKPGQPPKLLIYAASNPESGV PDRFSGSGSGTDFTLTISSLQAEDVAVYYCQQ IIEDPWTFGQGTKVEIKRTVAAPSVFIFPPSDE QLKSGTASVVCLLNNFYPREAKVQWKVDNA LQSGNSQESVTEQDSKDSTYSLSSTLTLSKAD YEKHKVYACEVTHQGLSSPVTKSFNRGECG GGGSGGGGSGGGGSGGGGSMLPAPKNLVVS RVTEDSARLSWTAPDAAFDSFHIEYAEPWV WGEAIVLTVPGSERSYDLTGLKPGTEYVVFIG GVKGGHNSTPLSAIFTT |
| 984 | PRT | Human | CR-5133HC355 | EVQLVETGGGLVKPGGSLRLSCSASRFSFRD YYMTWIRQAPGKGPEWVSHISGSGSTIYYAD SVRGRFTISRDNAKSSLYLQMDSLQADDTAV YYCARGGRATSYYWVHWGPGTLVTVSSAST KGPSVFPLAPSSKSTSGGTAALGCLVKDYFPE PVTVSWNSGALTSGVHTFPAVLQSSGLYSLS SVVTVPSSSLGTQTYICNVNHKPSNTKVDKK |

TABLE 6-continued

Nucleic Acid and Amino Acid Sequences of the Disclosure

| SEQ ID NO: | Type | Species | Description | Sequence |
|---|---|---|---|---|
| | | | | VEPKSCDKTHTCPPCPAPPVAGPDVFLFPPKP KDTLMISRTPEVTCVVVDVSHEDPEVKFNWY VDGVEVHNAKTKPREEQYNSTYRVVSVLTV LHQDWLNGKEYKCKVSNAALPAPIAKTISKA KGQPREPQVYTLPPSRDELTKNQVSLTCLVK GFYPSDIAVEWESNGQPENNYKTTPPVLDSD GSFFLYSKLTVDKSRWQQGNVFSCSVMHEA LHNRFTQKSLSLSPGKGGGGSGGGGSGGGGS GGGGSMLPAPKNLVVSRVTEDSARLSWTAP DAAFDSFGIGYLEYPWYGEAIVLTVPGSERSY DLTGLKPGTEYFVDIYGVKGGWWSYPLSAIF TTGGGGSGGGGSGGGGSGGGGSMLPAPKNL VVSRVTEDSARLSWTAPDAAFDSFWITYEEK FYRGEAIVLTVPGSERSYDLTGLKPGTEYKV WIVGVKGGQGSWPLSAIFTT |
| 985 | PRT | Human | CR-5133HC356 | EVQLVETGGGLVKPGGSLRLSCSASRFSFRD YYMTWIRQAPGKGPEWVSHISGSGSTIYYAD SVRGRFTISRDNAKSSLYLQMDSLQADDTAV YYCARGGRATSYYWVHWGPGTLVTVSSAST KGPSVFPLAPSSKSTSGGTAALGCLVKDYFPE PVTVSWNSGALTSGVHTFPAVLQSSGLYSLS SVVTVPSSSLGTQTYICNVNHKPSNTKVDKK VEPKSCDKTHTCPPCPAPPVAGPDVFLFPPKP KDTLMISRTPEVTCVVVDVSHEDPEVKFNWY VDGVEVHNAKTKPREEQYNSTYRVVSVLTV LHQDWLNGKEYKCKVSNAALPAPIAKTISKA KGQPREPQVYTLPPSRDELTKNQVSLTCLVK GFYPSDIAVEWESNGQPENNYKTTPPVLDSD GSFFLYSKLTVDKSRWQQGNVFSCSVMHEA LHNRFTQKSLSLSPGKGGGGSGGGGSGGGGS GGGGSMLPAPKNLVVSRVTEDSARLSWTAP DAAFDSFNIDYFEYYEFGEAIVLTVPGSERSY DLTGLKPGTEYFVDIYGVKGGSWSLPLSAIFT TGGGGSGGGGSGGGGSGGGGSMLPAPKNLV VSRVTEDSARLSWTAPDAAFDSFWITYEEKF YRGEAIVLTVPGSERSYDLTGLKPGTEYKVW IVGVKGGQGSWPLSAIFTT |
| 986 | PRT | Human | CR-5133HC357 | EVQLVETGGGLVKPGGSLRLSCSASRFSFRD YYMTWIRQAPGKGPEWVSHISGSGSTIYYAD SVRGRFTISRDNAKSSLYLQMDSLQADDTAV YYCARGGRATSYYWVHWGPGTLVTVSSAST KGPSVFPLAPSSKSTSGGTAALGCLVKDYFPE PVTVSWNSGALTSGVHTFPAVLQSSGLYSLS SVVTVPSSSLGTQTYICNVNHKPSNTKVDKK VEPKSCDKTHTCPPCPAPPVAGPDVFLFPPKP KDTLMISRTPEVTCVVVDVSHEDPEVKFNWY VDGVEVHNAKTKPREEQYNSTYRVVSVLTV LHQDWLNGKEYKCKVSNAALPAPIAKTISKA KGQPREPQVYTLPPSRDELTKNQVSLTCLVK GFYPSDIAVEWESNGQPENNYKTTPPVLDSD GSFFLYSKLTVDKSRWQQGNVFSCSVMHEA LHNRFTQKSLSLSPGKGGGGSGGGGSGGGGS GGGGSMLPAPKNLVVSRVTEDSARLSWTAP DAAFDSFNIHYAEYPDFGEAIVLTVPGSERSY DLTGLKPGTEYIVDIWGVKGGLGSWPLSAIFT TGGGGSGGGGSGGGGSGGGGSMLPAPKNLV VSRVTEDSARLSWTAPDAAFDSFWITYEEKF YRGEAIVLTVPGSERSYDLTGLKPGTEYKVW IVGVKGGQGSWPLSAIFTT |
| 987 | PRT | Human | CR-5133HC358 | EVQLVETGGGLVKPGGSLRLSCSASRFSFRD YYMTWIRQAPGKGPEWVSHISGSGSTIYYAD SVRGRFTISRDNAKSSLYLQMDSLQADDTAV YYCARGGRATSYYWVHWGPGTLVTVSSAST KGPSVFPLAPSSKSTSGGTAALGCLVKDYFPE PVTVSWNSGALTSGVHTFPAVLQSSGLYSLS SVVTVPSSSLGTQTYICNVNHKPSNTKVDKK VEPKSCDKTHTCPPCPAPPVAGPDVFLFPPKP KDTLMISRTPEVTCVVVDVSHEDPEVKFNWY VDGVEVHNAKTKPREEQYNSTYRVVSVLTV LHQDWLNGKEYKCKVSNAALPAPIAKTISKA KGQPREPQVYTLPPSRDELTKNQVSLTCLVK GFYPSDIAVEWESNGQPENNYKTTPPVLDSD |

TABLE 6-continued

Nucleic Acid and Amino Acid Sequences of the Disclosure

| SEQ ID NO: | Type | Species | Description | Sequence |
|---|---|---|---|---|
| | | | | GSFFLYSKLTVDKSRWQQGNVFSCSVMHEA LHNRFTQKSLSLSPGKGGGGSGGGGSGGGGS GGGGSMLPAPKNLVVSRVTEDSARLSWTAP DAAFDSFHIEYAEPWVWGEAIVLTVPGSERS YDLTGLKPGTEYVVFIGGVKGGHASTPLSAIF TTGGGGSGGGGSGGGGSGGGGSMLPAPKNL VVSRVTEDSARLSWTAPDAAFDSFWITYEEK FYRGEAIVLTVPGSERSYDLTGLKPGTEYKV WIVGVKGGQGSWPLSAIFTT |
| 988 | PRT | Human | CR-5133HC359 | EVQLVETGGGLVKPGGSLRLSCSASRFSFRD YYMTWIRQAPGKGPEWVSHISGSGSTIYYAD SVRGRFTISRDNAKSSLYLQMDSLQADDTAV YYCARGGRATSYYWVHWGPGTLVTVSSAST KGPSVFPLAPSSKSTSGGTAALGCLVKDYFPE PVTVSWNSGALTSGVHTFPAVLQSSGLYSLS SVVTVPSSSLGTQTYICNVNHKPSNTKVDKK VEPKSCDKTHTCPPCPAPPVAGPDVFLFPPKP KDTLMISRTPEVTCVVVDVSHEDPEVKFNWY VDGVEVHNAKTKPREEQYNSTYRVVSVLTV LHQDWLNGKEYKCKVSNAALPAPIAKTISKA KGQPREPQVYTLPPSRDELTKNQVSLTCLVK GFYPSDIAVEWESNGQPENNYKTTPPVLDSD GSFFLYSKLTVDKSRWQQGNVFSCSVMHEA LHNRFTQKSLSLSPGKGGGGSGGGGSGGGGS GGGGSMLPAPKNLVVSRVTEDSARLSWTAP DAAFDSFHIEYAEPWVWGEAIVLTVPGSERS YDLTGLKPGTEYVVFIGGVKGGHSSTPLSAIF TTGGGGSGGGGSGGGGSGGGGSMLPAPKNL VVSRVTEDSARLSWTAPDAAFDSFWITYEEK FYRGEAIVLTVPGSERSYDLTGLKPGTEYKV WIVGVKGGQGSWPLSAIFTT |
| 989 | PRT | Artificial | Luk26 Consensus Sequence | LPAPKNLVVSRVTEDSARLSWTAPDAAFDSF $X_{32}$I $X_{34}$Y $X_{36}$E $X_{38}$ $X_{39}$ $X_{40}$ $X_{41}$ $X_{42}$EAI $X_{46}$LTVPGSERSYDLTGLKPGT $X_{66}$Y $X_{68}$V $X_{70}$I $X_{72}$GVKG $X_{77}$ $X_{78}$ $X_{79}$ S $X_{81}$ $X_{82}$L $X_{84}$A $X_{86}$FTT $X_{32}$ is any amino acid residue, $X_{34}$ is E, $X_{36}$ is any amino acid residue, $X_{38}$ is any amino acid residue, $X_{39}$ is W or a functionally equivalent amino acid residue, $X_{40}$ is any amino acid residue, $X_{41}$ is W, $X_{42}$ is any amino acid residue, $X_{46}$ is any amino acid residue, $X_{66}$ is any amino acid residue, $X_{68}$ is any amino acid residue, $X_{70}$ is F, $X_{72}$ is G, $X_{77}$ is any amino acid residue, $X_{78}$ is any amino acid residue, $X_{79}$ is any amino acid residue, $X_{81}$ is any amino acid residue, $X_{82}$ is any amino acid residue, $X_{84}$ is any amino acid residue, and $X_{86}$ is any amino acid residue. |
| 990 | PRT | Artificial | Luk27 Consensus Sequence | LPAPKNLVVSRVTEDSARLSWTAPDAAFDSF $X_{32}$I $X_{34}$Y $X_{36}$E $X_{38}$ $X_{39}$ $X_{40}$ $X_{41}$ GEAI VLTVPGSERSYDLTGLKPGT EY $X_{68}$V $X_{70}$I $X_{72}$GVKG G $X_{78}$ $X_{79}$ S $X_{81}$ PLSAIFTT $X_{32}$ is any amino acid residue, $X_{34}$ is any amino acid residue, $X_{36}$ is any amino acid residue, $X_{38}$ is W, $X_{39}$ is any amino acid residue, $X_{40}$ is any amino acid residue $X_{41}$ is any amino acid residue, $X_{68}$ is L, $X_{70}$ is D, $X_{72}$ is Y, $X_{78}$ is any amino acid residue, $X_{79}$ is W, and $X_{81}$ is Y. |
| 991 | PRT | Artificial | Luk38 Consensus Sequence | LPAPKNLVVSRVTEDSARLSWTAPDAAFDSF LIQYQESEKVGEAIVLTVPGSERSYDLTGLKP GTEYTVSIYGV $X_{75}$ $X_{76}$ $X_{77}$ $X_{78}$ $X_{79}$ $X_{80}$$X_{81}$ $X_{82}$ $X_{83}$ $X_{84}$ $X_{85}$ $X_{86}$ SNPLSAIFTT $X_{75}$ is any amino acid residue, $X_{76}$ is any amino acid residue, $X_{77}$ is I, $X_{78}$ is any amino acid residue, $X_{79}$ is any amino acid residue, $X_{80}$ is G, $X_{81}$ is W, $X_{82}$ is L, $X_{83}$ is D, $X_{84}$ is F, $X_{85}$ is V, and $X_{86}$ is F. |
| 992 | PRT | Artificial | Luk17 Consensus | LPAPKNLVVSRVTEDSARLSWTAPDAAFDSF $X_{32}$I $X_{34}$Y $X_{36}$E $X_{38}$ $X_{39}$ $X_{40}$ $X_{41}$ $X_{42}$EAI $X_{46}$LTVPGSERSYDLTGLKPGT$X_{66}$Y $X_{68}$V $X_{70}$I |

TABLE 6-continued

Nucleic Acid and Amino Acid Sequences of the Disclosure

| SEQ ID NO: | Type | Species | Description | Sequence |
|---|---|---|---|---|
| | | | | $X_{72}$GVKG $X_{77}$ $X_{78}$ $X_{79}$ S $X_{81}$ $X_{82}$L $X_{84}$A $X_{86}$FTT<br>$X_{32}$ is W, $X_{34}$ is any amino acid residue, $X_{36}$ is E, $X_{38}$ is K, $X_{39}$ is F, $X_{40}$ is Y, $X_{41}$ is R, $X_{42}$ is any amino acid residue, $X_{42}$ is any amino acid residue, $X_{46}$ is any amino acid residue, $X_{66}$ is any amino acid residue, $X_{68}$ is K, $X_{70}$ is W, $X_{72}$ is any amino acid residue, $X_{77}$ is any amino acid residue, $X_{78}$ is any amino acid residue, $X_{79}$ is any amino acid residue, $X_{81}$ is W, $X_{82}$ is any amino acid residue<br>$X_{84}$ is any amino acid residue, and $X_{86}$ is any amino acid residue. |
| 993 | PRT | Artificial | Luk26 C strand/CD loop region consensus | DSF$X_{32}$I$X_{34}$Y$X_{36}$E$X_{38}$$X_{39}$$X_{40}$$X_{41}$$X_{42}$E<br>$X_{32}$ is any amino acid residue, $X_{34}$ is E, $X_{36}$ is any amino acid residue, $X_{38}$ is any amino acid residue, $X_{39}$ is W, $X_{40}$ is any amino acid residue, $X_{41}$ is W, $X_{42}$ is any amino acid residue. |
| 994 | PRT | Artificial | Luk26 F strand and FG loop region consensus | T$X_{66}$Y$X_{68}$V$X_{70}$I$X_{72}$GVKG $X_{77}$ $X_{78}$ $X_{79}$ S$X_{81}$<br>$X_{66}$ is any amino acid residue, $X_{68}$ is any amino acid residue, $X_{70}$ is F, $X_{72}$ is G, $X_{77}$ is any amino acid residue, $X_{78}$ is any amino acid residue, $X_{79}$ is any amino acid residue, $X_{81}$ is any amino acid residue. |
| 995 | PRT | Artificial | Luk27 C strand/CD loop region consensus | DSF$X_{32}$I$X_{34}$Y$X_{36}$E$X_{38}$$X_{39}$$X_{40}$$X_{41}$GE<br>$X_{32}$ is any amino acid residue, $X_{34}$ is any amino acid residue, $X_{36}$ is any amino acid residue, $X_{38}$ is W, $X_{39}$ is any amino acid residue, $X_{40}$ is any amino acid residue, and $X_{41}$ is any amino acid residue; |
| 996 | PRT | Artificial | Luk27 F strand and FG loop region consensus | TEY$X_{68}$V$X_{70}$I$X_{72}$GVKGG $X_{78}$ $X_{79}$ S$X_{81}$<br>$X_{68}$ is L, $X_{70}$ is D, $X_{72}$ is Y, $X_{78}$ is any amino acid residue, $X_{79}$ is W, and $X_{81}$ is Y. |
| 997 | PRT | Artificial | Luk38 FG loop region consensus | $X_{75}$ $X_{76}$ $X_{77}$ $X_{78}$ $X_{79}$ $X_{80}$$X_{81}$ $X_{82}$ $X_{83}$ $X_{84}$ $X_{85}$ $X_{86}$<br>$X_{75}$ is any amino acid residue, $X_{76}$ is any amino acid residue, $X_{77}$ is I, $X_{78}$ is any amino acid residue, $X_{79}$ is any amino acid residue, $X_{80}$ is G, $X_{81}$ is W, $X_{82}$ is L, $X_{83}$ is D, $X_{84}$ is F, $X_{85}$ is V, and $X_{86}$ is F. |
| 998 | PRT | Artificial | Luk17 C strand/CD loop region consensus | DSF$X_{32}$I$X_{34}$Y$X_{36}$E$X_{38}$$X_{39}$$X_{40}$$X_{41}$$X_{42}$E<br>$X_{32}$ is W, $X_{34}$ is any amino acid residue, $X_{36}$ is E, $X_{38}$ is K, $X_{39}$ is F, $X_{40}$ is Y, $X_{41}$ is R, and $X_{42}$ is any amino acid residue; |
| 999 | PRT | Artificial | Luk17 F strand and FG loop region consensus | T$X_{66}$Y$X_{68}$V$X_{70}$I$X_{72}$GVKG $X_{77}$ $X_{78}$ $X_{79}$ S$X_{81}$<br>$X_{66}$ is any amino acid residue, $X_{68}$ is K, $X_{70}$ is W, $X_{72}$ is any amino acid residue, $X_{77}$ is any amino acid residue, $X_{78}$ is any amino acid residue, $X_{79}$ is any amino acid residue, and $X_{81}$ is W. |
| 1000 | PRT | Human | ProteinA3HC41 | QVQLVQSGAEVKKPGSSVKVSCKASGGTFSS<br>YAISWVRQAPGQGLEWMGWISAINGNTNYA<br>QKFQGRVTITADESTSTAYMELSSLRSEDTAV<br>YYCARIWNPLLDYWGQGTLVTVSSASTKGPS<br>VFPLAPSSKSTSGGTAALGCLVKDYFPEPVTV<br>SWNSGALTSGVHTFPAVLQSSGLYSLSSVVT<br>VPSSSLGTQTYICNVNHKPSNTKVDKKVEPK<br>SCDKTHTCPPCPAPPVAGPDVFLFPPKPKDTL<br>MISRTPEVTCVVVDVSHEDPEVKFNWYVDG<br>VEVHNAKTKPREEQYNSTYRVVSVLTVLHQ<br>DWLNGKEYKCKVSNAALPAPIAKTISKAKGQ<br>PREPQVYTLPPSRDELTKNQVSLTCLVKGFYP<br>SDIAVEWESNGQPENNYKTTPPVLDSDGSFFL<br>YSKLTVDKSRWQQGNVFSCSVMHEALHNRF<br>TQKSLSLSPGK |
| 1001 | PRT | Human | ProteinA3HC39 | QVQLVQSGAEVKKPGSSVKVSCKASGGTFSS<br>YAISWVRQAPGQGLEWMGWISAINGNTNYA<br>QKFQGRVTITADESTSTAYMELSSLRSEDTAV<br>YYCARIWNFLLDYWGQGTLVTVSSASTKGPS |

TABLE 6-continued

Nucleic Acid and Amino Acid Sequences of the Disclosure

| SEQ ID NO: | Type | Species | Description | Sequence |
|---|---|---|---|---|
| | | | | VFPLAPSSKSTSGGTAALGCLVKDYFPEPVTV SWNSGALTSGVHTFPAVLQSSGLYSLSSVVT VPSSSLGTQTYICNVNHKPSNTKVDKKVEPK SCDKTHTCPPCPAPELLGGPSVFLFPPKPKDT LMISRTPEVTCVVVDVSHEDPEVKFNWYVD GVEVHNAKTKPREEQYNSTYRVVSVLTVLH QDWLNGKEYKCKVSNKALPAPIEKTISKAKG QPREPQVYTLPPSRDELTKNQVSLTCLVKGF YPSDIAVEWESNGQPENNYKTTPPVLDSDGS FFLYSKLTVDKSRWQQGNVFSCSVMHEALH NHYTQKSLSLSPGK |
| 1002 | PRT | Human | ProteinA3HC40 | QVQLVQSGAEVKKPGSSVKVSCKASGGTFSS YAISWVRQAPGQGLEWMGWISAINGNTNYA QKFQGRVTITADESTSTAYMELSSLRSEDTAV YYCARIWNFLLDYWGQGTLVTVSSASTKGPS VFPLAPSSKSTSGGTAALGCLVKDYFPEPVTV SWNSGALTSGVHTFPAVLQSSGLYSLSSVVT VPSSSLGTQTYICNVNHKPSNTKVDKKVEPK SCDKTHTCPPCPAPPVAGPDVFLFPPKPKDTL MISRTPEVTCVVVDVSHEDPEVKFNWYVDG VEVHNAKTKPREEQYNSTYRVVSVLTVLHQ DWLNGKEYKCKVSNAALPAPIAKTISKAKGQ PREPQVYTLPPSRDELTKNQVSLTCLVKGFYP SDIAVEWESNGQPENNYKTTPPVLDSDGSFFL YSKLTVDKSRWQQGNVFSCSVMHEALHNHY TQKSLSLSPGK |
| 1003 | PRT | Human | PagibaximabHC68 | EVMLVESGGGLVQPKGSLKLSCAASGFTFNN YAMNWVRQAPGKGLEWVARIRSKSNNYAT FYADSVKDRFTISRDDSQSMLYLQMNNLKTE DTAMYYCVRRGASGIDYAMDYWGQGTSLT VSSASTKGPSVFPLAPSSKSTSGGTAALGCLV KDYFPEPVTVSWNSGALTSGVHTFPAVLQSS GLYSLSSVVTVPSSSLGTQTYICNVNHKPSNT KVDKKVEPKSCDKTHTCPPCPAPELLGGPSV FLFPPKPKDTLMISRTPEVTCVVVDVSHEDPE VKFNWYVDGVEVHNAKTKPREEQYNSTYR VVSVLTVLHQDWLNGKEYKCKVSNKALPAP IEKTISKAKGQPREPQVYTLPPSRDELTKNQV SLTCLVKGFYPSDIAVEWESNGQPENNYKTT PPVLDSDGSFFLYSKLTVDKSRWQQGNVFSC SVMHEALHNHYTQKSLSLSPGK |
| 1004 | PRT | Human | PagibaximabHC23 | EVMLVESGGGLVQPKGSLKLSCAASGFTFNN YAMNWVRQAPGKGLEWVARIRSKSNNYAT FYADSVKDRFTISRDDSQSMLYLQMNNLKTE DTAMYYCVRRGASGIDYAMDYWGQGTSLT VSSASTKGPSVFPLAPSSKSTSGGTAALGCLV KDYFPEPVTVSWNSGALTSGVHTFPAVLQSS GLYSLSSVVTVPSSSLGTQTYICNVNHKPSNT KVDKKVEPKSCDKTHTCPPCPAPPVAGPDVF LFPPKPKDTLMISRTPEVTCVVVDVSHEDPEV KFNWYVDGVEVHNAKTKPREEQYNSTYRV VSVLTVLHQDWLNGKEYKCKVSNAALPAPI AKTISKAKGQPREPQVYTLPPSRDELTKNQVS LTCLVKGFYPSDIAVEWESNGQPENNYKTTP PVLDSDGSFFLYSKLTVDKSRWQQGNVFSCS VMHEALHNRFTQKSLSLSPGK |
| 1005 | PRT | Human | PagibaximabHC69 | EVMLVESGGGLVQPKGSLKLSCAASGFTFNN YAMNWVRQAPGKGLEWVARIRSKSNNYAT FYADSVKDRFTISRDDSQSMLYLQMNNLKTE DTAMYYCVRRGASGIDYAMDYWGQGTSLT VSSASTKGPSVFPLAPSSKSTSGGTAALGCLV KDYFPEPVTVSWNSGALTSGVHTFPAVLQSS GLYSLSSVVTVPSSSLGTQTYICNVNHKPSNT KVDKKVEPKSCDKTHTCPPCPAPPVAGPDVF LFPPKPKDTLMISRTPEVTCVVVDVSHEDPEV KFNWYVDGVEVHNAKTKPREEQYNSTYRV VSVLTVLHQDWLNGKEYKCKVSNAALPAPI AKTISKAKGQPREPQVYTLPPSRDELTKNQVS LTCLVKGFYPSDIAVEWESNGQPENNYKTTP PVLDSDGSFFLYSKLTVDKSRWQQGNVFSCS VMHEALHNHYTQKSLSLSPGK |

TABLE 6-continued

Nucleic Acid and Amino Acid Sequences of the Disclosure

| SEQ ID NO: | Type | Species | Description | Sequence |
|---|---|---|---|---|
| 1006 | PRT | Human | PagibaximabHC686 | EVMLVESGGGLVQPKGSLKLSCAASGFTFNN YAMNWVRQAPGKGLEWVARIRSKSNNYAT FYADSVKDRFTISRDDSQSMLYLQMNNLKTE DTAMYYCVRRGASGIDYAMDYWGQGTSLT VSSASTKGPSVFPLAPSSKSTSGGTAALGCLV KDYFPEPVTVSWNSGALTSGVHTFPAVLQSS GLYSLSSVVTVPSSSLGTQTYICNVNHKPSNT KVDKKVEPKSCDKTHTCPPCPAPELLGGPSV FLFPPKPKDTLMISRTPEVTCVVVDVSHEDPE VKFNWYVDGVEVHNAKTKPREEQYNSTYR VVSVLTVLHQDWLNGKEYKCKVSNKALPAP IEKTISKAKGQPREPQVYTLPPSRDELTKNQV SLTCLVKGFYPSDIAVEWESNGQPENNYKTT PPVLDSDGSFFLYSKLTVDKSRWQQGNVFSC SVMHEALHNRFTQKSLSLSPGK |
| 1007 | PRT | Human | ProteinA5HC42 | QVQLVQSGAEVKKPGSSVKVSCKASGGTFSS YAISWVRQAPGQGLEWMGGIIPIFGTANYAQ KFQGRVTITADESTSTAYMELSSLRSEDTAVY YCARTELRASWGDFDYWGQGTLVTVSSAST KGPSVFPLAPSSKSTSGGTAALGCLVKDYFPE PVTVSWNSGALTSGVHTFPAVLQSSGLYSLS SVVTVPSSSLGTQTYICNVNHKPSNTKVDKK VEPKSCDKTHTCPPCPAPELLGGPSVFLFPPK PKDTLMISRTPEVTCVVVDVSHEDPEVKFNW YVDGVEVHNAKTKPREEQYNSTYRVVSVLT VLHQDWLNGKEYKCKVSNKALPAPIEKTISK AKGQPREPQVYTLPPSRDELTKNQVSLTCLV KGFYPSDIAVEWESNGQPENNYKTTPPVLDS DGSFFLYSKLTVDKSRWQQGNVFSCSVMHE ALHNHYTQKSLSLSPGK |
| 1008 | PRT | Human | ProteinA5HC43 | QVQLVQSGAEVKKPGSSVKVSCKASGGTFSS YAISWVRQAPGQGLEWMGGIIPIFGTANYAQ KFQGRVTITADESTSTAYMELSSLRSEDTAVY YCARTELRASWGDFDYWGQGTLVTVSSAST KGPSVFPLAPSSKSTSGGTAALGCLVKDYFPE PVTVSWNSGALTSGVHTFPAVLQSSGLYSLS SVVTVPSSSLGTQTYICNVNHKPSNTKVDKK VEPKSCDKTHTCPPCPAPPVAGPDVFLFPPKP KDTLMISRTPEVTCVVVDVSHEDPEVKFNWY VDGVEVHNAKTKPREEQYNSTYRVVSVLTV LHQDWLNGKEYKCKVSNAALPAPIAKTISKA KGQPREPQVYTLPPSRDELTKNQVSLTCLVK GFYPSDIAVEWESNGQPENNYKTTPPVLDSD GSFFLYSKLTVDKSRWQQGNVFSCSVMHEA LHNHYTQKSLSLSPGK |
| 1009 | PRT | Human | ProteinAA5HC44 | QVQLVQSGAEVKKPGSSVKVSCKASGGTFSS YAISWVRQAPGQGLEWMGGIIPIFGTANYAQ KFQGRVTITADESTSTAYMELSSLRSEDTAVY YCARTELRASWGDFDYWGQGTLVTVSSAST KGPSVFPLAPSSKSTSGGTAALGCLVKDYFPE PVTVSWNSGALTSGVHTFPAVLQSSGLYSLS SVVTVPSSSLGTQTYICNVNHKPSNTKVDKK VEPKSCDKTHTCPPCPAPPVAGPDVFLFPPKP KDTLMISRTPEVTCVVVDVSHEDPEVKFNWY VDGVEVHNAKTKPREEQYNSTYRVVSVLTV LHQDWLNGKEYKCKVSNAALPAPIAKTISKA KGQPREPQVYTLPPSRDELTKNQVSLTCLVK GFYPSDIAVEWESNGQPENNYKTTPPVLDSD GSFFLYSKLTVDKSRWQQGNVFSCSVMHEA LHNRFTQKSLSLSPGK |
| 1010 | PRT | Human | ProteinA5HC45 | QVQLVQSGAEVKKPGSSVKVSCKASGGTFSS YAISWVRQAPGQGLEWMGGIIPIFGTANYAQ KFQGRVTITADESTSTAYMELSSLRSEDTAVY YCARTELRASWGDFDYWGQGTLVTVSSAST KGPSVFPLAPSSKSTSGGTAALGCLVKDYFPE PVTVSWNSGALTSGVHTFPAVLQSSGLYSLS SVVTVPSSSLGTQTYICNVNHKPSNTKVDKK VEPKSCDKTHTCPPCPAPELLGGPSVFLFPPK PKDTLMISRTPEVTCVVVDVSHEDPEVKFNW YVDGVEVHNAKTKPREEQYNSTYRVVSVLT |

TABLE 6-continued

Nucleic Acid and Amino Acid Sequences of the Disclosure

| SEQ ID NO: | Type | Species | Description | Sequence |
|---|---|---|---|---|
| | | | | VLHQDWLNGKEYKCKVSNKALPAPIEKTISK AKGQPREPQVYTLPPSRDELTKNQVSLTCLV KGFYPSDIAVEWESNGQPENNYKTTPPVLDS DGSFFLYSKLTVDKSRWQQGNVFSCSVMHE ALHNRFTQKSLSLSPGK |
| 1011 | PRT | Human | ProteinA3HC46 | QVQLVQSGAEVKKPGSSVKVSCKASGGTFSS YAISWVRQAPGQGLEWMGWISAINGNTNYA QKFQGRVTITADESTSTAYMELSSLRSEDTAV YYCARIWNFLLDYWGQGTLVTVSSASTKGPS VFPLAPSSKSTSGGTAALGCLVKDYFPEPVTV SWNSGALTSGVHTFPAVLQSSGLYSLSSVVT VPSSSLGTQTYICNVNHKPSNTKVDKKVEPK SCDKTHTCPPCPAPELLGGPSVFLFPPKPKDT LMISRTPEVTCVVVDVSHEDPEVKFNWYVD GVEVHNAKTKPREEQYNSTYRVVSVLTVLH QDWLNGKEYKCKVSNKALPAPIEKTISKAKG QPREPQVYTLPPSRDELTKNQVSLTCLVKGF YPSDIAVEWESNGQPENNYKTTPPVLDSDGS FFLYSKLTVDKSRWQQGNVFSCSVMHEALH NRFTQKSLSLSPGK |
| 1012 | PRT | Human | ProteinAA9HC47 | EVQLVQSGAEVKKPGESLKISCKGSGYSFTSY WIGWVRQMPGKGLEWMGIIYPGDSDTRYSP SFQGQVTISADKSISTAYLQWSSLKASDTAM YYCARWSYSQYSGWLDYWGQGTLVTVSSA STKGPSVFPLAPSSKSTSGGTAALGCLVKDYF PEPVTVSWNSGALTSGVHTFPAVLQSSGLYS LSSVVTVPSSSLGTQTYICNVNHKPSNTKVDK KVEPKSCDKTHTCPPCPAPELLGGPSVFLFPP KPKDTLMISRTPEVTCVVVDVSHEDPEVKFN WYVDGVEVHNAKTKPREEQYNSTYRVVSVL TVLHQDWLNGKEYKCKVSNKALPAPIEKTIS KAKGQPREPQVYTLPPSRDELTKNQVSLTCL VKGFYPSDIAVEWESNGQPENNYKTTPPVLD SDGSFFLYSKLTVDKSRWQQGNVFSCSVMH EALHNHYTQKSLSLSPGK |
| 1013 | PRT | Human | ProteinA9HC48 | EVQLVQSGAEVKKPGESLKISCKGSGYSFTSY WIGWVRQMPGKGLEWMGIIYPGDSDTRYSP SFQGQVTISADKSISTAYLQWSSLKASDTAM YYCARWSYSQYSGWLDYWGQGTLVTVSSA STKGPSVFPLAPSSKSTSGGTAALGCLVKDYF PEPVTVSWNSGALTSGVHTFPAVLQSSGLYS LSSVVTVPSSSLGTQTYICNVNHKPSNTKVDK KVEPKSCDKTHTCPPCPAPELLGGPSVFLFPP KPKDTLMISRTPEVTCVVVDVSHEDPEVKFN WYVDGVEVHNAKTKPREEQYNSTYRVVSVL TVLHQDWLNGKEYKCKVSNKALPAPIEKTIS KAKGQPREPQVYTLPPSRDELTKNQVSLTCL VKGFYPSDIAVEWESNGQPENNYKTTPPVLD SDGSFFLYSKLTVDKSRWQQGNVFSCSVMH EALHNRFTQKSLSLSPGK |
| 1014 | PRT | Human | ProteinA9HC49 | EVQLVQSGAEVKKPGESLKISCKGSGYSFTSY WIGWVRQMPGKGLEWMGIIYPGDSDTRYSP SFQGQVTISADKSISTAYLQWSSLKASDTAM YYCARWSYSQYSGWLDYWGQGTLVTVSSA STKGPSVFPLAPSSKSTSGGTAALGCLVKDYF PEPVTVSWNSGALTSGVHTFPAVLQSSGLYS LSSVVTVPSSSLGTQTYICNVNHKPSNTKVDK KVEPKSCDKTHTCPPCPAPPVAGPDVFLFPPK PKDTLMISRTPEVTCVVVDVSHEDPEVKFNW YVDGVEVHNAKTKPREEQYNSTYRVVSVLT VLHQDWLNGKEYKCKVSNAALPAPIAKTISK AKGQPREPQVYTLPPSRDELTKNQVSLTCLV KGFYPSDIAVEWESNGQPENNYKTTPPVLDS DGSFFLYSKLTVDKSRWQQGNVFSCSVMHE ALHNHYTQKSLSLSPGK |
| 1015 | PRT | Human | ProteinA9HC50 | EVQLVQSGAEVKKPGESLKISCKGSGYSFTSY WIGWVRQMPGKGLEWMGIIYPGDSDTRYSP SFQGQVTISADKSISTAYLQWSSLKASDTAM YYCARWSYSQYSGWLDYWGQGTLVTVSSA STKGPSVFPLAPSSKSTSGGTAALGCLVKDYF |

TABLE 6-continued

Nucleic Acid and Amino Acid Sequences of the Disclosure

| SEQ ID NO: | Type | Species | Description | Sequence |
|---|---|---|---|---|
| | | | | PEPVTVSWNSGALTSGVHTFPAVLQSSGLYS LSSVVTVPSSSLGTQTYICNVNHKPSNTKVDK KVEPKSCDKTHTCPPCPAPPVAGPDVFLFPPK PKDTLMISRTPEVTCVVVDVSHEDPEVKFNW YVDGVEVHNAKTKPREEQYNSTYRVVSVLT VLHQDWLNGKEYKCKVSNAALPAPIAKTISK AKGQPREPQVYTLPPSRDELTKNQVSLTCLV KGFYPSDIAVEWESNGQPENNYKTTPPVLDS DGSFFLYSKLTVDKSRWQQGNVFSCSVMHE ALHNRFTQKSLSLSPGK |
| 1016 | PRT | Human | ProteinA5LC | DIQMTQSPSSLSASVGDRVTITCRASQSISSYL NWYQQKPGKAPKLLIYAASSLQSGVPSRFSG SGSGTDFTLTISSLQPEDFATYYCQQSYSTPLT FGQGTKVEIKRTVAAPSVFIFPPSDEQLKSGT ASVVCLLNNFYPREAKVQWKVDNALQSGNS QESVTEQDSKDSTYSLSSTLTLSKADYEKHK VYACEVTHQGLSSPVTKSFNRGEC |
| 1017 | PRT | Artificial | Tencon | LPAPKNLVVSEVTEDSLRLSWTAPDAAFDSF LIQYQESEKVGEAINLTVPGSERSYDLTGLKP GTEYTVSIYGVKGGHRSNPLSAEFTT |
| 1018 | PRT | Artificial | LukA (PDB Entry 4tw1) | NSAHKDSQDQNKKEHVDKSQQKDKRNVTN KDKNSTAPDDIGKNGKITKRTETVYDEKTNIL QNLQFDFIDDPTYDKNVLLVKKQGSIHSNLK FESHKEEKNSNWLKYPSEYHVDFQVKRNRK TEILDQLPKNKISTAKVDSTFSYSSGGKFDST KGIGRTSSNSYSKTISYNQQNYDTIASGKNNN WHVHWSVIANDLKYGGEVKNRNDELLFYR NTRIATVENPELSFASKYRYPALVRSGFNPEF LTYLSNEKSNEKTQFEVTYTRNQDILKNRPGI HYAPPILEKNKDGQRLIVTYEVDWKNKTVK VVDKYSDDNKPYKEG |
| 1019 | PRT | Artificial | LukA (HDX) | NSAHHHHHHGSHKDSQDQNKKEHVDKSQQ KDKRNVTNKDKNSTAPDDIGKNGKITKRTET VYDEKTNILQNLQFDFIDDPTYDKNVLLVKK QGSIHSNLKFESHKEEKNSNWLKYPSEYHVD FQVKRNRKTEILDQLPKNKISTAKVDSTFSYS SGGKFDSTKGIGRTSSNSYSKTISYNQQNYDT IASGKNNNWHVHWSVIANDLKYGGEVKNR NDELLFYRNTRIATVENPELSFASKYRYPALV RSGFNPEFLTYLSNEKSNEKTQFEVTYTRNQ DILKNRPGIHYAPPILEKNKDGQRLIVTYEVD WKNKTVKVVDKYSDDNKPYKAG |
| 1020 | PRT | Artificial | LukA (Loop Mutants) | MNSAHHHHHHGSHKDSQDQNKKEHVDKSQ QKDKRNVTNKDKNSTAPDDIGKNGKITKRTE TVYDEKTNILQNLQFDFIDDPTYDKNVLLVK KQGSIHSNLKFESHKEEKNSNWLKYPSEYHV DFQVKRNRKTEILDQLPKNKISTAKVDSTFSY SSGGKFDSTKGIGRTSSNSYSKTISYNQQNYD TIASGKNNNWHVHWSVIANDLKYGGEVKNR NDELLFYRNTRIATVENPELSFASKYRYPALV RSGFNPEFLTYLSNEKSNEKTQFEVTYTRNQ DILKNRPGIHYAPPILEKNKDGQRLIVTYEVD WKNKTVKVVDKYSDDNKPYKAG |
| 1021 | PRT | Artificial | LukA (Point Mutants) | MNSAHHHHHHHHHGGGLNDIFEAQKIEWH EGSHKDSQDQNKKEHVDKSQQKDKRNVTN KDKNSTAPDDIGKNGKITKRTETVYDEKTNIL QNLQFDFIDDPTYDKNVLLVKKQGSIHSNLK FESHKEEKNSNWLKYPSEYHVDFQVKRNRK TEILDQLPKNKISTAKVDSTFSYSSGGKFDST KGIGRTSSNSYSKTISYNQQNYDTIASGKNNN WHVHWSVIANDLKYGGEVKNRNDELLFYR NTRIATVENPELSFASKYRYPALVRSGFNPEF LTYLSNEKSNEKTQFEVTYTRNQDILKNRPGI HYAPPILEKNKDGQRLIVTYEVDWKNKTVK VVDKYSDDNKPYKAG |
| 1022 | PRT | Artificial | LukA mut3 | MNSAHHHHHHGSHKDSQDQNKKEHVDKSQ QKDKRNVTNKDKNSTAPDDIGKNGKITKRTE TVYDEKTNILQNLQFDFIDDPTYDKNVLLVK |

TABLE 6-continued

Nucleic Acid and Amino Acid Sequences of the Disclosure

| SEQ ID NO: | Type | Species | Description | Sequence |
|---|---|---|---|---|
| | | | | KQGSIHSNLKFESHKEEKNSNWLKYPSEYHV DFQVKRNRKTEILDQLPKNKISGGSGGNYDTI ASGKNNNWHVHWSVIANDLKYGGEVKNRN DELLFYRNTRIATVENPELSFASKYRYPALVR SGFNPEFLTYLSNEKSNEKTQFEVTYTRNQDI LKNRPGIHYAPPILEKNKDGQRLIVTYEVDW KNKTVKVVDKYSDDNKPYKAG |
| 1023 | PRT | Artificial | LukA mut4 | MNSAHHHHHGSHKDSQDQNKKEHVDKSQ QKDKRNVTNKDKNSTAPDDIGKNGKITKRTE TVYDEKTNILQNLQFDFIDDPTYDKNVLLVK KQGSIHSNLKFESHKEEKNSNWLKYPSEYHV DFQVKRNRKTEILDQLPKNKISGGSGNYDTIA SGKNNNWHVHWSVIANDLKYGGEVKNRND ELLFYRNTRIATVENPELSFASKYRYPALVRS GFNPEFLTYLSNEKSNEKTQFEVTYTRNQDIL KNRPGIHYAPPILEKNKDGQRLIVTYEVDWK NKTVKVVDKYSDDNKPYKAG |
| 1024 | PRT | Artificial | LukA mut5 | MNSAHHHHHGSHKDSQDQNKKEHVDKSQ QKDKRNVTNKDKNSTAPDDIGKNGKITKRTE TVYDEKTNILQNLQFDFIDDPTYDKNVLLVK KQGSIHSNLKFESHKEEKNSNWLKYPSEYHV DFQVKRNRKTEILDQLPKNSGGSGQNYDTIA SGKNNNWHVHWSVIANDLKYGGEVKNRND ELLFYRNTRIATVENPELSFASKYRYPALVRS GFNPEFLTYLSNEKSNEKTQFEVTYTRNQDIL KNRPGIHYAPPILEKNKDGQRLIVTYEVDWK NKTVKVVDKYSDDNKPYKAG |
| 1025 | PRT | Artificial | LukA mut6 | MNSAHHHHHGSHKDSQDQNKKEHVDKSQ QKDKRNVTNKDKNSTAPDDIGKNGKITKRTE TVYDEKTNILQNLQFDFIDDPTYDKNVLLVK KQGSIHSNLKFESHKEEKNSNWLKYPSEYHV DFQVKRNRKTEILDQLPKNSGGSGGQNYDTI ASGKNNNWHVHWSVIANDLKYGGEVKNRN DELLFYRNTRIATVENPELSFASKYRYPALVR SGFNPEFLTYLSNEKSNEKTQFEVTYTRNQDI LKNRPGIHYAPPILEKNKDGQRLIVTYEVDW KNKTVKVVDKYSDDNKPYKAG |
| 1026 | PRT | Artificial | LukB (PDB Entry 4tw1) | KINSEIKQVSEKNLDGDTKMYTRTATTSDSQ KNITQSLQFNFLTEPNYDKETVFIKAKGTIGS GLRILDPNGYWNSTLRWPGSYSVSIQNVDDN NNTNVTDFAPKNQDESREVKYTYGYKTGGD FSINRGGLTGNITKESNYSETISYQQPSYRTLL DQSTSHKGVGWKVEAHLINNMGHDHTRQLT NDSDNRTKSEIFSLTRNGNLWAKDNFTPKDK MPVTVSEGFNPEFLAVMSHDKKDKGKSQFV VHYKRSMDEFKIDWNRHGFWGYWSGENHV DKKEEKLSALYEVDWKTHNVKFVKVLND |
| 1027 | PRT | Artificial | LukB (HDX) | KINSEIKQVSEKNLDGDTKMYTRTATTSDSQ KNITQSLQFNFLTEPNYDKETVFIKAKGTIGS GLRILDPNGYWNSTLRWPGSYSVSIQNVDDN NNTNVTDFAPKNQDESREVKYTYGYKTGGD FSINRGGLTGNITKESNYSETISYQQPSYRTLL DQSTSHKGVGWKVEAHLINNMGHDHTRQLT NDSDNRTKSEIFSLTRNGNLWAKDNFTPKDK MPVTVSEGFNPEFLAVMSHDKKDKGKSQFV VHYKRSMDEFKIDWNRHGFWGYWSGENHV DKKEEKLSALYEVDWKTHNVKFVKVLNDNE KK |
| 1028 | PRT | Artificial | LukB (Mutants) | MKINSEIKQVSEKNLDGDTKMYTRTATTSDS QKNITQSLQFNFLTEPNYDKETVFIKAKGTIG SGLRILDPNGYWNSTLRWPGSYSVSIQNVDD NNNTNVTDFAPKNQDESREVKYTYGYKTGG DFSINRGGLTGNITKESNYSETISYQQPSYRTL LDQSTSHKGVGWKVEAHLINNMGHDHTRQL TNDSDNRTKSEIFSLTRNGNLWAKDNFTPKD KMPVTVSEGFNPEFLAVMSHDKKDKGKSQF VVHYKRSMDEFKIDWNRHGFWGYWSGENH VDKKEEKLSALYEVDWKTHNVKFVKVLND NEKK |

TABLE 6-continued

Nucleic Acid and Amino Acid Sequences of the Disclosure

| SEQ ID NO: | Type | Species | Description | Sequence |
|---|---|---|---|---|
| 1029 | PRT | Artificial | LukB mut3 | MKINSEIKQVSEKNLDGDTKMYTRTATTSDS QKNITQSLQFNFLTEPNYDKETVFIKAKGTIG SGLRILDPNGYWNSTLRWPGSYSVSIQNVDD NNNTNVTDFAPKNQDESGGSGGSYRTLLDQS TSHKGVGWKVEAHLINNMGHDHTRQLTNDS DNRTKSEIFSLTRNGNLWAKDNFTPKDKMPV TVSEGFNPEFLAVMSHDKKDKGKSQFVVHY KRSMDEFKIDWNRHGFWGYWSGENHVDKK EEKLSALYEVDWKTHNVKFVKVLNDNEKK |
| 1030 | PRT | Artificial | LukB mut4 | MKINSEIKQVSEKNLDGDTKMYTRTATTSDS QKNITQSLQFNFLTEPNYDKETVFIKAKGTIG SGLRILDPNGYWNSTLRWPGSYSVSIQNVDD NNNTNVTDFAPKNQDESGGSGSYRTLLDQST SHKGVGWKVEAHLINNMGHDHTRQLTNDS DNRTKSEIFSLTRNGNLWAKDNFTPKDKMPV TVSEGFNPEFLAVMSHDKKDKGKSQFVVHY KRSMDEFKIDWNRHGFWGYWSGENHVDKK EEKLSALYEVDWKTHNVKFVKVLNDNEKK |
| 1031 | PRT | Artificial | LukB mut5 | MKINSEIKQVSEKNLDGDTKMYTRTATTSDS QKNITQSLQFNFLTEPNYDKETVFIKAKGTIG SGLRILDPNGYWNSTLRWPGSYSVSIQNVDD NNNTNVTDFAPKNQDESGGSGPSYRTLLDQS TSHKGVGWKVEAHLINNMGHDHTRQLTNDS DNRTKSEIFSLTRNGNLWAKDNFTPKDKMPV TVSEGFNPEFLAVMSHDKKDKGKSQFVVHY KRSMDEFKIDWNRHGFWGYWSGENHVDKK EEKLSALYEVDWKTHNVKFVKVLNDNEKK |
| 1032 | PRT | Artificial | LukB mut6 | MKINSEIKQVSEKNLDGDTKMYTRTATTSDS QKNITQSLQFNFLTEPNYDKETVFIKAKGTIG SGLRILDPNGYWNSTLRWPGSYSVSIQNVDD NNNTNVTDFAPKNQSGGSGPSYRTLLDQSTS HKGVGWKVEAHLINNMGHDHTRQLTNDSD NRTKSEIFSLTRNGNLWAKDNFTPKDKMPVT VSEGFNPEFLAVMSHDKKDKGKSQFVVHYK RSMDEFKIDWNRHGFWGYWSGENHVDKKE EKLSALYEVDWKTHNVKFVKVLNDNEKK |
| 1033 | PRT | Artificial | LukB_Y74A | MKINSEIKQVSEKNLDGDTKMYTRTATTSDS QKNITQSLQFNFLTEPNYDKETVFIKAKGTIG SGLRILDPNGAWNSTLRWPGSYSVSIQNVDD NNNTNVTDFAPKNQDESREVKYTYGYKTGG DFSINRGGLTGNITKESNYSETISYQQPSYRTL LDQSTSHKGVGWKVEAHLINNMGHDHTRQL TNDSDNRTKSEIFSLTRNGNLWAKDNFTPKD KMPVTVSEGFNPEFLAVMSHDKKDKGKSQF VVHYKRSMDEFKIDWNRHGFWGYWSGENH VDKKEEKLSALYEVDWKTHNVKFVKVLND NEKK |
| 1034 | PRT | Artificial | LukB_W75A | MKINSEIKQVSEKNLDGDTKMYTRTATTSDS QKNITQSLQFNFLTEPNYDKETVFIKAKGTIG SGLRILDPNGYANSTLRWPGSYSVSIQNVDD NNNTNVTDFAPKNQDESREVKYTYGYKTGG DFSINRGGLTGNITKESNYSETISYQQPSYRTL LDQSTSHKGVGWKVEAHLINNMGHDHTRQL TNDSDNRTKSEIFSLTRNGNLWAKDNFTPKD KMPVTVSEGFNPEFLAVMSHDKKDKGKSQF VVHYKRSMDEFKIDWNRHGFWGYWSGENH VDKKEEKLSALYEVDWKTHNVKFVKVLND NEKK |
| 1035 | PRT | Artificial | LukB_R194A | MKINSEIKQVSEKNLDGDTKMYTRTATTSDS QKNITQSLQFNFLTEPNYDKETVFIKAKGTIG SGLRILDPNGYWNSTLRWPGSYSVSIQNVDD NNNTNVTDFAPKNQDESREVKYTYGYKTGG DFSINRGGLTGNITKESNYSETISYQQPSYRTL LDQSTSHKGVGWKVEAHLINNMGHDHTRQL TNDSDNATKSEIFSLTRNGNLWAKDNFTPKD KMPVTVSEGFNPEFLAVMSHDKKDKGKSQF |

TABLE 6-continued

Nucleic Acid and Amino Acid Sequences of the Disclosure

| SEQ ID NO: | Type | Species | Description | Sequence |
|---|---|---|---|---|
| | | | | VVHYKRSMDEFKIDWNRHGFWGYWSGENH VDKKEEKLSALYEVDWKTHNVKFVKVLND NEKK |
| 1036 | PRT | Artificial | LukB_K196A | MKINSEIKQVSEKNLDGDTKMYTRTATTSDS QKNITQSLQFNFLTEPNYDKETVFIKAKGTIG SGLRILDPNGYWNSTLRWPGSYSVSIQNVDD NNNTNVTDFAPKNQDESREVKYTYGYKTGG DFSINRGGLTGNITKESNYSETISYQQPSYRTL LDQSTSHKGVGWKVEAHLINNMGHDHTRQL TNDSDNRTASEIFSLTRNGNLWAKDNFTPKD KMPVTVSEGFNPEFLAVMSHDKKDKGKSQF VVHYKRSMDEFKIDWNRHGFWGYWSGENH VDKKEEKLSALYEVDWKTHNVKFVKVLND NEKK |
| 1037 | PRT | Artificial | LukB_R204A | MKINSEIKQVSEKNLDGDTKMYTRTATTSDS QKNITQSLQFNFLTEPNYDKETVFIKAKGTIG SGLRILDPNGYWNSTLRWPGSYSVSIQNVDD NNNTNVTDFAPKNQDESREVKYTYGYKTGG DFSINRGGLTGNITKESNYSETISYQQPSYRTL LDQSTSHKGVGWKVEAHLINNMGHDHTRQL TNDSDNRTKSEIFSLTANGNLWAKDNFTPKD KMPVTVSEGFNPEFLAVMSHDKKDKGKSQF VVHYKRSMDEFKIDWNRHGFWGYWSGENH VDKKEEKLSALYEVDWKTHNVKFVKVLND NEKK |
| 1038 | PRT | Artificial | LukB_N205A | MKINSEIKQVSEKNLDGDTKMYTRTATTSDS QKNITQSLQFNFLTEPNYDKETVFIKAKGTIG SGLRILDPNGYWNSTLRWPGSYSVSIQNVDD NNNTNVTDFAPKNQDESREVKYTYGYKTGG DFSINRGGLTGNITKESNYSETISYQQPSYRTL LDQSTSHKGVGWKVEAHLINNMGHDHTRQL TNDSDNRTKSEIFSLTRAGNLWAKDNFTPKD KMPVTVSEGFNPEFLAVMSHDKKDKGKSQF VVHYKRSMDEFKIDWNRHGFWGYWSGENH VDKKEEKLSALYEVDWKTHNVKFVKVLND NEKK |
| 1039 | PRT | Artificial | LukB_N207A | MKINSEIKQVSEKNLDGDTKMYTRTATTSDS QKNITQSLQFNFLTEPNYDKETVFIKAKGTIG SGLRILDPNGYWNSTLRWPGSYSVSIQNVDD NNNTNVTDFAPKNQDESREVKYTYGYKTGG DFSINRGGLTGNITKESNYSETISYQQPSYRTL LDQSTSHKGVGWKVEAHLINNMGHDHTRQL TNDSDNRTKSEIFSLTRNGALWAKDNFTPKD KMPVTVSEGFNPEFLAVMSHDKKDKGKSQF VVHYKRSMDEFKIDWNRHGFWGYWSGENH VDKKEEKLSALYEVDWKTHNVKFVKVLND NEKK |
| 1040 | PRT | Artificial | LukB_W209A | MKINSEIKQVSEKNLDGDTKMYTRTATTSDS QKNITQSLQFNFLTEPNYDKETVFIKAKGTIG SGLRILDPNGYWNSTLRWPGSYSVSIQNVDD NNNTNVTDFAPKNQDESREVKYTYGYKTGG DFSINRGGLTGNITKESNYSETISYQQPSYRTL LDQSTSHKGVGWKVEAHLINNMGHDHTRQL TNDSDNRTKSEIFSLTRNGNLAAKDNFTPKD KMPVTVSEGFNPEFLAVMSHDKKDKGKSQF VVHYKRSMDEFKIDWNRHGFWGYWSGENH VDKKEEKLSALYEVDWKTHNVKFVKVLND NEKK |
| 1041 | PRT | Artificial | LukB_D262A | MKINSEIKQVSEKNLDGDTKMYTRTATTSDS QKNITQSLQFNFLTEPNYDKETVFIKAKGTIG SGLRILDPNGYWNSTLRWPGSYSVSIQNVDD NNNTNVTDFAPKNQDESREVKYTYGYKTGG DFSINRGGLTGNITKESNYSETISYQQPSYRTL LDQSTSHKGVGWKVEAHLINNMGHDHTRQL TNDSDNRTKSEIFSLTRNGNLWAKDNFTPKD KMPVTVSEGFNPEFLAVMSHDKKDKGKSQF VVHYKRSMDEFKIAWNRHGFWGYWSGENH VDKKEEKLSALYEVDWKTHNVKFVKVLND NEKK |

TABLE 6-continued

Nucleic Acid and Amino Acid Sequences of the Disclosure

| SEQ ID NO: | Type | Species | Description | Sequence |
|---|---|---|---|---|
| 1042 | PRT | Artificial | LukB_D262R | MKINSEIKQVSEKNLDGDTKMYTRTATTSDS QKNITQSLQFNFLTEPNYDKETVFIKAKGTIG SGLRILDPNGYWNSTLRWPGSYSVSIQNVDD NNNTNVTDFAPKNQDESREVKYTYGYKTGG DFSINRGGLTGNITKESNYSETISYQQPSYRTL LDQSTSHKGVGWKVEAHLINNMGHDHTRQL TNDSDNRTKSEIFSLTRNGNLWAKDNFTPKD KMPVTVSEGFNPEFLAVMSHDKKDKGKSQF VVHYKRSMDEFKIRWNRHGFWGYWSGENH VDKKEEKLSALYEVDWKTHNVKFVKVLND NEKK |
| 1043 | PRT | Artificial | LukB_W263A | MKINSEIKQVSEKNLDGDTKMYTRTATTSDS QKNITQSLQFNFLTEPNYDKETVFIKAKGTIG SGLRILDPNGYWNSTLRWPGSYSVSIQNVDD NNNTNVTDFAPKNQDESREVKYTYGYKTGG DFSINRGGLTGNITKESNYSETISYQQPSYRTL LDQSTSHKGVGWKVEAHLINNMGHDHTRQL TNDSDNRTKSEIFSLTRNGNLWAKDNFTPKD KMPVTVSEGFNPEFLAVMSHDKKDKGKSQF VVHYKRSMDEFKIDANRHGFWGYWSGENH VDKKEEKLSALYEVDWKTHNVKFVKVLND NEKK |
| 1044 | PRT | Artificial | LukB_N264A | MKINSEIKQVSEKNLDGDTKMYTRTATTSDS QKNITQSLQFNFLTEPNYDKETVFIKAKGTIG SGLRILDPNGYWNSTLRWPGSYSVSIQNVDD NNNTNVTDFAPKNQDESREVKYTYGYKTGG DFSINRGGLTGNITKESNYSETISYQQPSYRTL LDQSTSHKGVGWKVEAHLINNMGHDHTRQL TNDSDNRTKSEIFSLTRNGNLWAKDNFTPKD KMPVTVSEGFNPEFLAVMSHDKKDKGKSQF VVHYKRSMDEFKIDWARHGFWGYWSGENH VDKKEEKLSALYEVDWKTHNVKFVKVLND NEKK |
| 1045 | PRT | Artificial | LukB_R265A | MKINSEIKQVSEKNLDGDTKMYTRTATTSDS QKNITQSLQFNFLTEPNYDKETVFIKAKGTIG SGLRILDPNGYWNSTLRWPGSYSVSIQNVDD NNNTNVTDFAPKNQDESREVKYTYGYKTGG DFSINRGGLTGNITKESNYSETISYQQPSYRTL LDQSTSHKGVGWKVEAHLINNMGHDHTRQL TNDSDNRTKSEIFSLTRNGNLWAKDNFTPKD KMPVTVSEGFNPEFLAVMSHDKKDKGKSQF VVHYKRSMDEFKIDWNAHGFWGYWSGENH VDKKEEKLSALYEVDWKTHNVKFVKVLND NEKK |
| 1046 | PRT | Artificial | LukB_R265E | MKINSEIKQVSEKNLDGDTKMYTRTATTSDS QKNITQSLQFNFLTEPNYDKETVFIKAKGTIG SGLRILDPNGYWNSTLRWPGSYSVSIQNVDD NNNTNVTDFAPKNQDESREVKYTYGYKTGG DFSINRGGLTGNITKESNYSETISYQQPSYRTL LDQSTSHKGVGWKVEAHLINNMGHDHTRQL TNDSDNRTKSEIFSLTRNGNLWAKDNFTPKD KMPVTVSEGFNPEFLAVMSHDKKDKGKSQF VVHYKRSMDEFKIDWNEHGFWGYWSGENH VDKKEEKLSALYEVDWKTHNVKFVKVLND NEKK |
| 1047 | PRT | Artificial | LukB_H266A | MKINSEIKQVSEKNLDGDTKMYTRTATTSDS QKNITQSLQFNFLTEPNYDKETVFIKAKGTIG SGLRILDPNGYWNSTLRWPGSYSVSIQNVDD NNNTNVTDFAPKNQDESREVKYTYGYKTGG DFSINRGGLTGNITKESNYSETISYQQPSYRTL LDQSTSHKGVGWKVEAHLINNMGHDHTRQL TNDSDNRTKSEIFSLTRNGNLWAKDNFTPKD KMPVTVSEGFNPEFLAVMSHDKKDKGKSQF VVHYKRSMDEFKIDWNRAGFWGYWSGENH VDKKEEKLSALYEVDWKTHNVKFVKVLND NEKK |

TABLE 6-continued

Nucleic Acid and Amino Acid Sequences of the Disclosure

| SEQ ID NO: | Type | Species | Description | Sequence |
|---|---|---|---|---|
| 1048 | PRT | Artificial | LukB_G267R | MKINSEIKQVSEKNLDGDTKMYTRTATTSDS QKNITQSLQFNFLTEPNYDKETVFIKAKGTIG SGLRILDPNGYWNSTLRWPGSYSVSIQNVDD NNNTNVTDFAPKNQDESREVKYTYGYKTGG DFSINRGGLTGNITKESNYSETISYQQPSYRTL LDQSTSHKGVGWKVEAHLINNMGHDHTRQL TNDSDNRTKSEIFSLTRNGNLWAKDNFTPKD KMPVTVSEGFNPEFLAVMSHDKKDKGKSQF VVHYKRSMDEFKIDWNRHRFWGYWSGENH VDKKEEKLSALYEVDWKTHNVKFVKVLND NEKK |
| 1049 | PRT | Artificial | LukB_G267A | MKINSEIKQVSEKNLDGDTKMYTRTATTSDS QKNITQSLQFNFLTEPNYDKETVFIKAKGTIG SGLRILDPNGYWNSTLRWPGSYSVSIQNVDD NNNTNVTDFAPKNQDESREVKYTYGYKTGG DFSINRGGLTGNITKESNYSETISYQQPSYRTL LDQSTSHKGVGWKVEAHLINNMGHDHTRQL TNDSDNRTKSEIFSLTRNGNLWAKDNFTPKD KMPVTVSEGFNPEFLAVMSHDKKDKGKSQF VVHYKRSMDEFKIDWNRHAFWGYWSGENH VDKKEEKLSALYEVDWKTHNVKFVKVLND NEKK |
| 1050 | PRT | Artificial | LukB_F268A | MKINSEIKQVSEKNLDGDTKMYTRTATTSDS QKNITQSLQFNFLTEPNYDKETVFIKAKGTIG SGLRILDPNGYWNSTLRWPGSYSVSIQNVDD NNNTNVTDFAPKNQDESREVKYTYGYKTGG DFSINRGGLTGNITKESNYSETISYQQPSYRTL LDQSTSHKGVGWKVEAHLINNMGHDHTRQL TNDSDNRTKSEIFSLTRNGNLWAKDNFTPKD KMPVTVSEGFNPEFLAVMSHDKKDKGKSQF VVHYKRSMDEFKIDWNRHGAWGYWSGENH VDKKEEKLSALYEVDWKTHNVKFVKVLND NEKK |
| 1051 | PRT | Artificial | LukB_W269A | MKINSEIKQVSEKNLDGDTKMYTRTATTSDS QKNITQSLQFNFLTEPNYDKETVFIKAKGTIG SGLRILDPNGYWNSTLRWPGSYSVSIQNVDD NNNTNVTDFAPKNQDESREVKYTYGYKTGG DFSINRGGLTGNITKESNYSETISYQQPSYRTL LDQSTSHKGVGWKVEAHLINNMGHDHTRQL TNDSDNRTKSEIFSLTRNGNLWAKDNFTPKD KMPVTVSEGFNPEFLAVMSHDKKDKGKSQF VVHYKRSMDEFKIDWNRHGFAGYWSGENH VDKKEEKLSALYEVDWKTHNVKFVKVLND NEKK |
| 1052 | PRT | Artificial | LukB_Y271A | MKINSEIKQVSEKNLDGDTKMYTRTATTSDS QKNITQSLQFNFLTEPNYDKETVFIKAKGTIG SGLRILDPNGYWNSTLRWPGSYSVSIQNVDD NNNTNVTDFAPKNQDESREVKYTYGYKTGG DFSINRGGLTGNITKESNYSETISYQQPSYRTL LDQSTSHKGVGWKVEAHLINNMGHDHTRQL TNDSDNRTKSEIFSLTRNGNLWAKDNFTPKD KMPVTVSEGFNPEFLAVMSHDKKDKGKSQF VVHYKRSMDEFKIDWNRHGFWGAWSGENH VDKKEEKLSALYEVDWKTHNVKFVKVLND NEKK |
| 1053 | PRT | Artificial | Luk17 | MLPAPKNLVVSRVTEDSARLSWTAPDAAFDS FWITYEEKFYRGEAIVLTVPGSERSYDLTGLK PGTEYKVWIVGVKGGQGSWPLSAIFTTGGHH HHHH |
| 1054 | PRT | Artificial | LukE (PDB Entry 3rohA) | MFKKKMLAATLSVGLIAPLASPIQESRANTNI ENIGDGAEVIKRTEDVSSKKWGVTQNVQFDF VKDKKYNKDALIVKMQGFINSRTSFSDVKGS GYELTKRMIWPFQYNIGLTTKDPNVSLINYLP KNKIETTDVGQTLGYNIGGNFQSAPSIGGNGS FNYSKTISYTQKSYVSEVDKQNSKSVKWGV KANEFVTPDGKKSAHDRYLFVQSPNGPTGSA REYFAPDNQLPPLVQSGFNPSFITTLSHEKGSS |

TABLE 6-continued

Nucleic Acid and Amino Acid Sequences of the Disclosure

| SEQ ID NO: | Type | Species | Description | Sequence |
|---|---|---|---|---|
| | | | | DTSEFEISYGRNLDITYATLFPRTGIYAERKHN AFVNRNFVVRYEVNWKTHEIKVKGHN |
| 1055 | PRT | Artificial | LukE (HDX) | NSAHHHHHHGSNTNIENIGDGAEVIKRTEDV SSKKWGVTQNVQFDFVKDKKYNKDALIVK MQGFINSRTSFSDVKGSGYELTKRMIWPFQY NIGLTTKDPNVSLINYLPKNKIETTDVGQTLG YNIGGNFQSAPSIGGNGSFNYSKTISYTQKSY VSEVDKQNSKSVKWGVKANEFVTPDGKKSA HDRYLFVQSPNGPTGSAREYFAPDNQLPPLV QSGFNPSFITTLSHEKGSSDTSEFELSYGRNLD ITYATLFPRTGIYAERKHNAFVNRNFVVRYK VNWKTHEIKVKGHN |
| 1056 | PRT | Artificial | LukE (Mutants) | MGSSGLNDIFEAQKIEWHEGGHHHHHHHH HSSGLVPRGSHMLENTNIENIGDGAEVIKRTE DVSSKKWGVTQNVQFDFVKDKKYNKDALIV KMQGFINSRTSFSDVKGSGYELTKRMIWPFQ YNIGLTTKDPNVSLINYLPKNKIETTDVGQTL GYNIGGNFQSAPSIGGNGSFNYSKTISYTQKS YVSEVDKQNSKSVKWGVKANEFVTPDGKKS AHDRYLFVQSPNGPTGSAREYFAPDNQLPPL VQSGFNPSFITTLSHEKGSSDTSEFEISYGRNL DITYATLFPRTGIYAERKHNAFVNRNFVVRY EVNWKTHEIKVKGHN |
| 1057 | PRT | Artificial | LukE_S105A | MGSSGLNDIFEAQKIEWHEGGHHHHHHHH HSSGLVPRGSHMLENTNIENIGDGAEVIKRTE DVSSKKWGVTQNVQFDFVKDKKYNKDALIV KMQGFINSRTSFADVKGSGYELTKRMIWPFQ YNIGLTTKDPNVSLINYLPKNKIETTDVGQTL GYNIGGNFQSAPSIGGNGSFNYSKTISYTQKS YVSEVDKQNSKSVKWGVKANEFVTPDGKKS AHDRYLFVQSPNGPTGSAREYFAPDNQLPPL VQSGFNPSFITTLSHEKGSSDTSEFEISYGRNL DITYATLFPRTGIYAERKHNAFVNRNFVVRY EVNWKTHEIKVKGHN |
| 1058 | PRT | Artificial | LukE_V107A | MGSSGLNDIFEAQKIEWHEGGHHHHHHHH HSSGLVPRGSHMLENTNIENIGDGAEVIKRTE DVSSKKWGVTQNVQFDFVKDKKYNKDALIV KMQGFINSRTSFSDAKGSGYELTKRMIWPFQ YNIGLTTKDPNVSLINYLPKNKIETTDVGQTL GYNIGGNFQSAPSIGGNGSFNYSKTISYTQKS YVSEVDKQNSKSVKWGVKANEFVTPDGKKS AHDRYLFVQSPNGPTGSAREYFAPDNQLPPL VQSGFNPSFITTLSHEKGSSDTSEFEISYGRNL DITYATLFPRTGIYAERKHNAFVNRNFVVRY EVNWKTHEIKVKGHN |
| 1059 | PRT | Artificial | LukE_K108A | MGSSGLNDIFEAQKIEWHEGGHHHHHHHH HSSGLVPRGSHMLENTNIENIGDGAEVIKRTE DVSSKKWGVTQNVQFDFVKDKKYNKDALIV KMQGFINSRTSFSDVAGSGYELTKRMIWPFQ YNIGLTTKDPNVSLINYLPKNKIETTDVGQTL GYNIGGNFQSAPSIGGNGSFNYSKTISYTQKS YVSEVDKQNSKSVKWGVKANEFVTPDGKKS AHDRYLFVQSPNGPTGSAREYFAPDNQLPPL VQSGFNPSFITTLSHEKGSSDTSEFEISYGRNL DITYATLFPRTGIYAERKHNAFVNRNFVVRY EVNWKTHEIKVKGHN |
| 1060 | PRT | Artificial | LukE_G109R | MGSSGLNDIFEAQKIEWHEGGHHHHHHHH HSSGLVPRGSHMLENTNIENIGDGAEVIKRTE DVSSKKWGVTQNVQFDFVKDKKYNKDALIV KMQGFINSRTSFSDVKRSGYELTKRMIWPFQ YNIGLTTKDPNVSLINYLPKNKIETTDVGQTL GYNIGGNFQSAPSIGGNGSFNYSKTISYTQKS YVSEVDKQNSKSVKWGVKANEFVTPDGKKS AHDRYLFVQSPNGPTGSAREYFAPDNQLPPL VQSGFNPSFITTLSHEKGSSDTSEFEISYGRNL DITYATLFPRTGIYAERKHNAFVNRNFVVRY EVNWKTHEIKVKGHN |

TABLE 6-continued

Nucleic Acid and Amino Acid Sequences of the Disclosure

| SEQ ID NO: | Type | Species | Description | Sequence |
|---|---|---|---|---|
| 1061 | PRT | Artificial | LukE_Y112A | MGSSGLNDIFEAQKIEWHEGGHHHHHHHH HSSGLVPRGSHMLENTNIENIGDGAEVIKRTE DVSSKKWGVTQNVQFDFVKDKKYNKDALIV KMQGFINSRTSFSDVKGSGAELTKRMIWPFQ YNIGLTTKDPNVSLINYLPKNKIETTDVGQTL GYNIGGNFQSAPSIGGNGSFNYSKTISYTQKS YVSEVDKQNSKSVKWGVKANEFVTPDGKKS AHDRYLFVQSPNGPTGSAREYFAPDNQLPPL VQSGFNPSFITTLSHEKGSSDTSEFEISYGRNL DITYATLFPRTGIYAERKHNAFVNRNFVVRY EVNWKTHEIKVKGHN |
| 1062 | PRT | Artificial | LukE_L114A | MGSSGLNDIFEAQKIEWHEGGHHHHHHHH HSSGLVPRGSHMLENTNIENIGDGAEVIKRTE DVSSKKWGVTQNVQFDFVKDKKYNKDALIV KMQGFINSRTSFSDVKGSGYEATKRMIWPFQ YNIGLTTKDPNVSLINYLPKNKIETTDVGQTL GYNIGGNFQSAPSIGGNGSFNYSKTISYTQKS YVSEVDKQNSKSVKWGVKANEFVTPDGKKS AHDRYLFVQSPNGPTGSAREYFAPDNQLPPL VQSGFNPSFITTLSHEKGSSDTSEFEISYGRNL DITYATLFPRTGIYAERKHNAFVNRNFVVRY EVNWKTHEIKVKGHN |
| 1063 | PRT | Artificial | LukE_T115A | MGSSGLNDIFEAQKIEWHEGGHHHHHHHH HSSGLVPRGSHMLENTNIENIGDGAEVIKRTE DVSSKKWGVTQNVQFDFVKDKKYNKDALIV KMQGFINSRTSFSDVKGSGYELAKRMIWPFQ YNIGLTTKDPNVSLINYLPKNKIETTDVGQTL GYNIGGNFQSAPSIGGNGSFNYSKTISYTQKS YVSEVDKQNSKSVKWGVKANEFVTPDGKKS AHDRYLFVQSPNGPTGSAREYFAPDNQLPPL VQSGFNPSFITTLSHEKGSSDTSEFEISYGRNL DITYATLFPRTGIYAERKHNAFVNRNFVVRY EVNWKTHEIKVKGHN |
| 1064 | PRT | Artificial | LukE_R117A | MGSSGLNDIFEAQKIEWHEGGHHHHHHHH HSSGLVPRGSHMLENTNIENIGDGAEVIKRTE DVSSKKWGVTQNVQFDFVKDKKYNKDALIV KMQGFINSRTSFSDVKGSGYELTKAMIWPFQ YNIGLTTKDPNVSLINYLPKNKIETTDVGQTL GYNIGGNFQSAPSIGGNGSFNYSKTISYTQKS YVSEVDKQNSKSVKWGVKANEFVTPDGKKS AHDRYLFVQSPNGPTGSAREYFAPDNQLPPL VQSGFNPSFITTLSHEKGSSDTSEFEISYGRNL DITYATLFPRTGIYAERKHNAFVNRNFVVRY EVNWKTHEIKVKGHN |
| 1065 | PRT | Artificial | LukE_I283A | MGSSGLNDIFEAQKIEWHEGGHHHHHHHH HSSGLVPRGSHMLENTNIENIGDGAEVIKRTE DVSSKKWGVTQNVQFDFVKDKKYNKDALIV KMQGFINSRTSFSDVKGSGYELTKRMIWPFQ YNIGLTTKDPNVSLINYLPKNKIETTDVGQTL GYNIGGNFQSAPSIGGNGSFNYSKTISYTQKS YVSEVDKQNSKSVKWGVKANEFVTPDGKKS AHDRYLFVQSPNGPTGSAREYFAPDNQLPPL VQSGFNPSFITTLSHEKGSSDTSEFEISYGRNL DATYATLFPRTGIYAERKHNAFVNRNFVVRY EVNWKTHEIKVKGHN |
| 1066 | PRT | Artificial | LukE_Y285A | MGSSGLNDIFEAQKIEWHEGGHHHHHHHH HSSGLVPRGSHMLENTNIENIGDGAEVIKRTE DVSSKKWGVTQNVQFDFVKDKKYNKDALIV KMQGFINSRTSFSDVKGSGYELTKRMIWPFQ YNIGLTTKDPNVSLINYLPKNKIETTDVGQTL GYNIGGNFQSAPSIGGNGSFNYSKTISYTQKS YVSEVDKQNSKSVKWGVKANEFVTPDGKKS AHDRYLFVQSPNGPTGSAREYFAPDNQLPPL VQSGFNPSFITTLSHEKGSSDTSEFEISYGRNL DITAATLFPRTGIYAERKHNAFVNRNFVVRY EVNWKTHEIKVKGHN |
| 1067 | PRT | Artificial | LukE_T287A | MGSSGLNDIFEAQKIEWHEGGHHHHHHHH HSSGLVPRGSHMLENTNIENIGDGAEVIKRTE |

TABLE 6-continued

Nucleic Acid and Amino Acid Sequences of the Disclosure

| SEQ ID NO: | Type | Species | Description | Sequence |
|---|---|---|---|---|
| | | | | DVSSKKWGVTQNVQFDFVKDKKYNKDALIV KMQGFINSRTSFSDVKGSGYELTKRMIWPFQ YNIGLTTKDPNVSLINYLPKNKIETTDVGQTL GYNIGGNFQSAPSIGGNGSFNYSKTISYTQKS YVSEVDKQNSKSVKWGVKANEFVTPDGKKS AHDRYLFVQSPNGPTGSAREYFAPDNQLPPL VQSGFNPSFITTLSHEKGSSDTSEFEISYGRNL DITYAALFPRTGIYAERKHNAFVNRNFVVRY EVNWKTHEIKVKGHN |
| 1068 | PRT | Artificial | LukE_F289A | MGSSGLNDIFEAQKIEWHEGGHHHHHHHHH HSSGLVPRGSHMLENTNIENIGDGAEVIKRTE DVSSKKWGVTQNVQFDFVKDKKYNKDALIV KMQGFINSRTSFSDVKGSGYELTKRMIWPFQ YNIGLTTKDPNVSLINYLPKNKIETTDVGQTL GYNIGGNFQSAPSIGGNGSFNYSKTISYTQKS YVSEVDKQNSKSVKWGVKANEFVTPDGKKS AHDRYLFVQSPNGPTGSAREYFAPDNQLPPL VQSGFNPSFITTLSHEKGSSDTSEFEISYGRNL DITYATLAPRTGIYAERKHNAFVNRNFVVRY EVNWKTHEIKVKGHN |
| 1069 | PRT | Artificial | LukE_T292A | MGSSGLNDIFEAQKIEWHEGGHHHHHHHHH HSSGLVPRGSHMLENTNIENIGDGAEVIKRTE DVSSKKWGVTQNVQFDFVKDKKYNKDALIV KMQGFINSRTSFSDVKGSGYELTKRMIWPFQ YNIGLTTKDPNVSLINYLPKNKIETTDVGQTL GYNIGGNFQSAPSIGGNGSFNYSKTISYTQKS YVSEVDKQNSKSVKWGVKANEFVTPDGKKS AHDRYLFVQSPNGPTGSAREYFAPDNQLPPL VQSGFNPSFITTLSHEKGSSDTSEFEISYGRNL DITYATLFPRAGIYAERKHNAFVNRNFVVRY EVNWKTHEIKVKGHN |
| 1070 | PRT | Artificial | LukE_Y295A | MGSSGLNDIFEAQKIEWHEGGHHHHHHHHH HSSGLVPRGSHMLENTNIENIGDGAEVIKRTE DVSSKKWGVTQNVQFDFVKDKKYNKDALIV KMQGFINSRTSFSDVKGSGYELTKRMIWPFQ YNIGLTTKDPNVSLINYLPKNKIETTDVGQTL GYNIGGNFQSAPSIGGNGSFNYSKTISYTQKS YVSEVDKQNSKSVKWGVKANEFVTPDGKKS AHDRYLFVQSPNGPTGSAREYFAPDNQLPPL VQSGFNPSFITTLSHEKGSSDTSEFEISYGRNL DITYATLFPRTGIAAERKHNAFVNRNFVVRY EVNWKTHEIKVKGHN |
| 1071 | PRT | Artificial | LukE_E297A | MGSSGLNDIFEAQKIEWHEGGHHHHHHHHH HSSGLVPRGSHMLENTNIENIGDGAEVIKRTE DVSSKKWGVTQNVQFDFVKDKKYNKDALIV KMQGFINSRTSFSDVKGSGYELTKRMIWPFQ YNIGLTTKDPNVSLINYLPKNKIETTDVGQTL GYNIGGNFQSAPSIGGNGSFNYSKTISYTQKS YVSEVDKQNSKSVKWGVKANEFVTPDGKKS AHDRYLFVQSPNGPTGSAREYFAPDNQLPPL VQSGFNPSFITTLSHEKGSSDTSEFEISYGRNL DITYATLFPRTGIYAARKHNAFVNRNFVVRY EVNWKTHEIKVKGHN |
| 1072 | PRT | Artificial | LukE_K299A | MGSSGLNDIFEAQKIEWHEGGHHHHHHHHH HSSGLVPRGSHMLENTNIENIGDGAEVIKRTE DVSSKKWGVTQNVQFDFVKDKKYNKDALIV KMQGFINSRTSFSDVKGSGYELTKRMIWPFQ YNIGLTTKDPNVSLINYLPKNKIETTDVGQTL GYNIGGNFQSAPSIGGNGSFNYSKTISYTQKS YVSEVDKQNSKSVKWGVKANEFVTPDGKKS AHDRYLFVQSPNGPTGSAREYFAPDNQLPPL VQSGFNPSFITTLSHEKGSSDTSEFEISYGRNL DITYATLFPRTGIYAERAHNAFVNRNFVVRY EVNWKTHEIKVKGHN |
| 1073 | PRT | Artificial | LukE_H300A | MGSSGLNDIFEAQKIEWHEGGHHHHHHHHH HSSGLVPRGSHMLENTNIENIGDGAEVIKRTE DVSSKKWGVTQNVQFDFVKDKKYNKDALIV KMQGFINSRTSFSDVKGSGYELTKRMIWPFQ YNIGLTTKDPNVSLINYLPKNKIETTDVGQTL |

TABLE 6-continued

Nucleic Acid and Amino Acid Sequences of the Disclosure

| SEQ ID NO: | Type | Species | Description | Sequence |
|---|---|---|---|---|
| | | | | GYNIGGNFQSAPSIGGNGSFNYSKTISYTQKS YVSEVDKQNSKSVKWGVKANEFVTPDGKKS AHDRYLFVQSPNGPTGSAREYFAPDNQLPPL VQSGFNPSFITTLSHEKGSSDTSEFEISYGRNL DITYATLFPRTGIYAERKANAFVNRNFVVRY EVNWKTHEIKVKGHN |
| 1074 | PRT | Artificial | LukE_N301A | MGSSGLNDIFEAQKIEWHEGGHHHHHHHHH HSSGLVPRGSHMLENTNIENIGDGAEVIKRTE DVSSKKWGVTQNVQFDFVKDKKYNKDALIV KMQGFINSRTSFSDVKGSGYELTKRMIWPFQ YNIGLTTKDPNVSLINYLPKNKIETTDVGQTL GYNIGGNFQSAPSIGGNGSFNYSKTISYTQKS YVSEVDKQNSKSVKWGVKANEFVTPDGKKS AHDRYLFVQSPNGPTGSAREYFAPDNQLPPL VQSGFNPSFITTLSHEKGSSDTSEFEISYGRNL DITYATLFPRTGIYAERKHAAFVNRNFVVRY EVNWKTHEIKVKGHN |
| 1075 | PRT | Artificial | LukE_F303A | MGSSGLNDIFEAQKIEWHEGGHHHHHHHHH HSSGLVPRGSHMLENTNIENIGDGAEVIKRTE DVSSKKWGVTQNVQFDFVKDKKYNKDALIV KMQGFINSRTSFSDVKGSGYELTKRMIWPFQ YNIGLTTKDPNVSLINYLPKNKIETTDVGQTL GYNIGGNFQSAPSIGGNGSFNYSKTISYTQKS YVSEVDKQNSKSVKWGVKANEFVTPDGKKS AHDRYLFVQSPNGPTGSAREYFAPDNQLPPL VQSGFNPSFITTLSHEKGSSDTSEFEISYGRNL DITYATLFPRTGIYAERKHNAAVNRNFVVRY EVNWKTHEIKVKGHN |
| 1076 | PRT | Artificial | LukE_R306A | MGSSGLNDIFEAQKIEWHEGGHHHHHHHHH HSSGLVPRGSHMLENTNIENIGDGAEVIKRTE DVSSKKWGVTQNVQFDFVKDKKYNKDALIV KMQGFINSRTSFSDVKGSGYELTKRMIWPFQ YNIGLTTKDPNVSLINYLPKNKIETTDVGQTL GYNIGGNFQSAPSIGGNGSFNYSKTISYTQKS YVSEVDKQNSKSVKWGVKANEFVTPDGKKS AHDRYLFVQSPNGPTGSAREYFAPDNQLPPL VQSGFNPSFITTLSHEKGSSDTSEFEISYGRNL DITYATLFPRTGIYAERKHNAFVNANFVVRY EVNWKTHEIKVKGHN |
| 1077 | PRT | Artificial | Luk26 | MLPAPKNLVVSRVTEDSARLSWTAPDAAFDS FHIEYAEPWVWGEAIVLTVPGSERSYDLTGL KPGTEYVVFIGGVKGGHNSTPLSAIFTTGGHH HHHH |
| 1078 | PRT | Artificial | LukABHC111 | EVQLQQSGAELVKPGASVKISCKASGYAFSS SWMNWLKQRPGKGLEWIGRIYPGDGDTNYN GKFKGKATLTADKSSSTAYMQLSSLTSEDSA VYFCARYGYDYDGEYYYAMDYWGQGTSVT VSSAKTTPPSVYPLAPGSAAQTNSMVTLGCL VKGYFPEPVTVTWNSGSLSSGVHTFPAVLES DLYTLSSSVTVPSSPRPSETVTCNVAHPASST KVDKKIVPRDCGCKPCICTVPEVSSVFIFPPKP KDVLTITLTPKVTCVVVDISKDDPEVQFSWF VDDVEVHTAQTQPREEQFNSTFRSVSELPIM HQDWLNGKEFKCRVNSAAFPAPIEKTISKTK GRPKAPQVYTIPPPKEQMAKDKVSLTCMITD FFPEDITVEWQWNGQPAENYKNTQPIMNTN GSYFVYSKLNVQKSNWEAGNTFTCSVLHEG LHNHHTEKSLSHSPGK |
| 1079 | PRT | Artificial | LukABLC111 | DIVMTQSPTTMAASPGERITITCSAHSNLISNY LHWYQQKPGFSPKLLIYRTSNLASGVPARFS GSGSGTSYSLTIGTMEAEDVATYFCQQGSSIP FTFGSGTKLEIKRADAAPTVSIFPPSSEQLTSG GASVVCFLNNFYPKDINVKWKIDGSERQNGV LNSWTDQDSKDSTYSMSSTLTLTKDEYERHN SYTCEATHKTSTSPIVKSFNRNEC |
| 1080 | PRT | Artificial | FabHC214 | EVQLQQSGAELVKPGASVKISCKASGYAFSS SWMNWLKQRPGKGLEWIGRIYPGDGDTNYN GKFKGKATLTADKSSSTAYMQLSSLTSEDSA |

TABLE 6-continued

Nucleic Acid and Amino Acid Sequences of the Disclosure

| SEQ ID NO: | Type | Species | Description | Sequence |
|---|---|---|---|---|
| | | | | VYFCARYGYDYDGEYYYAMDYWGQGTSVT VSSASTKGPSVFPLAPSSKSTSGGTAALGCLV KDYFPEPVTVSWNSGALTSGVHTFPAVLQSS GLYSLSSVVTVPSSSLGTQTYICNVNHKPSNT KVDKKVEPKSCHHHHHH |
| 1081 | PRT | Artificial | FabLC214 | DIVMTQSPTTMAASPGERITITCSAHSNLISNY LHWYQQKPGFSPKLLIYRTSNLASGVPARFS GSGSGTSYSLTIGTMEAEDVATYFCQQGSSIP FTFGSGTKLEIKRTVAAPSVFIFPPSDEQLKSG TASVVCLLNNFYPREAKVQWKVDNALQSGN SQESVTEQDSKDSTYSLSSTLTLSKADYEKHK VYACEVTHQGLSSPVTKSFNRGEC |
| 1082 | PRT | Artificial | FabHC229 | EVQLVETGGGLVKPGGSLRLSCSASRFSFRD YYMTWIRQAPGKGPEWVSHISGSGSTIYYAD SVRGRFTISRDNAKSSLYLQMDSLQADDTAV YYCARGGRATSYYWVHWGPGTLVTVSSAST KGPSVFPLAPSSKSTSGGTAALGCLVKDYFPE PVTVSWNSGALTSGVHTFPAVLQSSGLYSLS SVVTVPSSSLGTQTYICNVNHKPSNTKVDKK VEPKSCHHHHHH |
| 1083 | PRT | Artificial | FabLC229 | EIVLTQSPATLSLSPGERATLSCRASQSVSGYL GWYQQKPGQAPRLLIYGASSRATGIPDRFSG SGSGTDFTLTISRLEPEDFAVYYCQQYGSSPL TFGGGTKLEIKRTVAAPSVFIFPPSDEQLKSGT ASVVCLLNNFYPREAKVQWKVDNALQSGNS QESVTEQDSKDSTYSLSSTLTLSKADYEKHK VYACEVTHQGLSSPVTKSFNRGEC |
| 1084 | PRT | Artificial | TD peptide | LCBiot-TDTDTDTDTDTDTDTDTDTDHHHHHHHH-OH |
| 1085 | PRT | Artificial | SD-GlcNAc peptide | LCBiot-SDSDSDSDSDSDSDSD(SGlcNAc)DHHHHH HHH-OH |
| 1086 | PRT | Artificial | Hla H35L toxoid | MKTRIVSSVTTTLLLGSILMNPVANAADSDIN IKTGTTDIGSNTTVKTGDLVTYDKENGMLKK VFYSFIDDKNHNKKLLVIRTKGTIAGQYRVY SEEGANKSGLAWPSAFKVQLQLPDNEVAQIS DYYPRNSIDTKEYMSTLTYGFNGNVTGDDTG KIGGLIGANVSIGHTLKYVQPDFKTILESPTDK KVGWKVIFNNMVNQNWGPYDRDSWNPVYG NQLFMKTRNGSMKAADNFLDPNKASSLLSS GFSPDFATVITMDRKASKQQTNIDVIYERVRD DYQLHWTSTNWKGTNTKDKWIDRSSERYKI DWEKEEMTNHHHHHH |
| 1087 | PRT | Artificial | Luk957 Hla binding FN3 domain | LPAPKNLVVSRVTEDSARLSWGEAPIWVAFD SFLIQYQESEKVGEAIVLTVPGSERSYDLTGL KPGTEYTVSIYGVFQPNNFHSNPLSAIFTT |
| 1088 | PRT | Artificial | Luk958 Hla binding FN3 domain | LPAPKNLVVSRVTEDSARLSWEANAWDDVN FDSFLIQYRESEKVGEAIVLTVPGSERSYDLT GLKPGTEYTVSIYGVWNQTHYRWPSNPLSAI FTT |
| 1089 | PRT | Artificial | Luk959 Hla binding FN3 domain | LPAPKNLVVSRVTEDSARLSWTYIFPIFDSFLI QYQESEKVGEAIVLTVPGSERSYDLTGLKPG TEYTVSIYGVLQYFEFTSNPLSAIFTT |
| 1090 | PRT | Artificial | Luk960 Hla binding FN3 domain | LPAPKNLVVSRVTEDSARLSWDSEELFLFDSF LIQYQESEKVGEAIVLTIPGSERSYDLTGLKPG TEYTVSIYGVWGHWDYWKTSNPLSAIFTT |
| 1091 | PRT | Artificial | Luk961 Hla binding FN3 domain | LPAPKNLVVSRVTEDSARLSWDSEELFLFDSF LIQYQESEKVGEAIVLTVPGSERSYDLTGLKP GTEYTVSIYGVWGHWDYWKTSNPLSAIFTT |
| 1092 | PRT | Artificial | Luk962 Hla binding FN3 domain | LPAPKNLVVSRVTEDSARLSWKVEHEFDSFLI QYQESEKVGEAIVLTVPGSERSYDLTGLKPG TEYTVSIYGVGDSQWYFWRFSNPLSAIFTT |

TABLE 6-continued

Nucleic Acid and Amino Acid Sequences of the Disclosure

| SEQ ID NO: | Type | Species | Description | Sequence |
|---|---|---|---|---|
| 1093 | PRT | Artificial | Luk963 Hla binding FN3 domain | LPAPKNLVVSRVTEDSARLSWGEEVHWLFDS FLIQYQESEKVGEAIVLTVPGSERSYDLTSLK PGTEYTVSIYGVAGYAHWFTTWSNPLSAIFTT |
| 1094 | PRT | Artificial | Luk964 Hla binding FN3 domain | LPAPKNLVVSRVTEDSARLSWAPSHFPRSFDS FLIQYQESEKVGEAIVLTVPGSERSYDLTGLK PGTEYTVSIYGVLTVATIRWQSNPLSAIFTT |
| 1095 | PRT | Artificial | Luk965 Hla binding FN3 domain | LPAPKNLVVSRVTEDSARLSWDEQLWIQFDS FLIQYQESEKVGEAIVLTVPGSERSYDLTGLK PGTEYTVSIYGVVPWLPNYWQVSNPLSAIFTT |
| 1096 | PRT | Artificial | Luk966 Hla binding FN3 domain | LPAPKNLVVSRVTEDSARLSWWSENWVNWF DSFLIQYQESEKVGEAIVLTVPGSERSYDLTG LKPGTEYTVSIYGVWEVKNRIRWLSNPLSAIF TT |
| 1097 | PRT | Artificial | Luk967 Hla binding FN3 domain | LPAPKNLVVSRVTEDSARLSWEANAWDDVN FDSFLIQYQESEKVGEAIVLTVPGSERSYDLT GLKPGTEYTVSIYGVWNQTHYRWPSNPLSAI FTT |
| 1098 | PRT | Artificial | Luk968 Hla binding FN3 domain | LPAPKNLVVSRVTEDSARLSWVDKRHPDFDS FLIQYQESEKVGEAIVLTVPGSERSYDLTGLK PGTEYTVSIYGVHGFLQWYWSTSNPLSAIFTT |
| 1099 | PRT | Artificial | Luk969 Hla binding FN3 domain | LPAPKNLVVSRVTEDSARLSWNSEIAEQFFFD SFLIQYQESEKVGEAIVLTVPGSERSYDLTGL KPGTEYTVSIYGVWGHWDWYWKTSNPLSAI FTT |
| 1100 | PRT | Artificial | Luk970 Hla binding FN3 domain | LPAPKNLVVSRVTEDSARLSWNRGLIPFDSFL IQYQESEKVGEAIVLTVPGSERSYDLTGLKLG TEYTVSIYGVGTYYPWWPLSNPLSAIFTT |
| 1101 | PRT | Artificial | Luk971 Hla binding FN3 domain | LPAPKNLVVSRVTEDSARLSWSPWFFGQFDS FLIQYQESEKVGEAIVLTVPGSERSYDLTGLK PGTEYTVSIYGVIELGQQYSFTSNPLSAIFTT |
| 1102 | PRT | Artificial | Luk972 Hla binding FN3 domain | LPAPKNLVVSRVTEDSARLSWNSEIAEQFFFD SFLIQYQESEKVGEAIVLTVPGSERSYDLTGL KPGTEYTVSIYGVWGHWDWYWKTSNPLSAI VTT |
| 1103 | PRT | Artificial | Luk973 Hla binding FN3 domain | LPAPKNLVVSRVTEDSARLSWTAPDAAFDSF GIGYPEFYRKGEAIQLRVPGSERSYDLTGLKP GTEYTVSIYGVSDLTTHWWLLSNPLSAIFTT |
| 1104 | PRT | Artificial | Luk974 Hla binding FN3 domain | LPAPKNLVVSRVTEDSARLSWGEEVHWLFDS FLIQYQESEKVGEAIVLTVPGSERSYDLTGLK PGTEYTVSIYGVAGYAHWFTTWSNPLSAIFTT |
| 1105 | PRT | Artificial | Luk975 Hla binding FN3 domain | LPAPKNLVVSRVTEDSARLSWTAPDAAFDSF AISYQELDPEGEAINLSVPGSERSYDLTGLKP GTKYLVTIDGVKGGKASKPLPANFTT |
| 1106 | PRT | Artificial | Luk976 Hla binding FN3 domain | LPAPKNLVVSRVTEDSARLSWDTLTPWIIFDS FLIQYQESEKVGEAIVLTVPGSERSYDLTGLK PGTEYTVSIYGVQPWQVYYQYSNPLSAIFTT |
| 1107 | PRT | Artificial | Luk977 Hla binding FN3 domain | LPAPKNLVVSRVTEDSARLSWGASIERSRWF DSFLIQYQESEKVGEAIVLTVPGSERSYDLTG QKPGTEYTVSIYGVHNVPNLFVQGSNPLSAIF TT |
| 1108 | PRT | Artificial | Luk978 Hla binding FN3 domain | LPAPKNLVVSRVTEDSARLSWKAYHFIFDSFL IQYQESEKVGEAIVLTVPGSERSYDLTGLKPG TEYTVSIYGVRSDYVYWASNPLSAIFTT |
| 1109 | PRT | Artificial | Luk979 Hla binding FN3 domain | LPAPKNLVVSRVTEDSARLSWQIFPAFARFDS FLIQYQESEKVGEAIVLTVPGSERSYDLTGLK PGTEYTVSIYGVIFGPHTFQSNPLSAIFTT |

TABLE 6-continued

Nucleic Acid and Amino Acid Sequences of the Disclosure

| SEQ ID NO: | Type | Species | Description | Sequence |
|---|---|---|---|---|
| 1110 | PRT | Artificial | Luk980 Hla binding FN3 domain | LPAPKNLVVSRVTEDSARLSWRISFPHFDSFLI QYQESEKVGEAIVLTVRGSERSYDLTGLKPG TEYTVSIYGVLWYWRAYSNPLSAIFTT |
| 1111 | PRT | Artificial | Luk981 Hla binding FN3 domain | LPAPKNLVVSRVTEDSARLSWEANAWDDVN FDSFLIQYQESEKVGDAIVLTVPGSERSYDLT GLKPGTEYTVSIYGVWNQTHYRWPSNPLSAI FTT |
| 1112 | PRT | Artificial | Luk982 Hla binding FN3 domain | LPAPKNLVVSRVTEDSARLSWTAPDAAFDSF AIGYPEYHDAGEAIHLFVPGSERSYDLTGLKP GTEYVVAIRGVKGGHASEPLHAHFTT |
| 1113 | PRT | Artificial | Luk983 Hla binding FN3 domain | LPAPKNLVVSRVTEDSARLSWKRNGVFEVNF DSFLIQYQESEKVGEAIVLTVPGSERSYDLTG LKPGTEYTVSIYGVWNQTHYRWPSNPLSAIF TT |
| 1114 | PRT | Artificial | Luk984 Hla binding FN3 domain | LPAPKNLVVSRVTEDSARLSWFVTWRNGFFD SFLIQYQESEKVGEAIVLTVPGSERSYDLTGL KPGTEYTVSIYGVVHQYYPHYWFSNPLSAIFTT |
| 1115 | PRT | Artificial | Luk985 Hla binding FN3 domain | LPAPKNLVVSRVTEDSARLSWKRNGVFEVNF DSFLIQYRESEKVGEAIVLTVPGSERSYDLTG LKPGTEYTVSIYGVWNQTHYRWPSNPLSAIF TT |
| 1116 | PRT | Artificial | Luk986 Hla binding FN3 domain | LPAPKNLVVSRVTEDSARLSWTAPDAAFDSF LIQYQESEKVGEAIVLTVPGSERSYDLTGLKP GTEYTVSIYGVITLLFNGAVLSNPLSAIFTT |
| 1117 | PRT | Artificial | Luk987 Hla binding FN3 domain | LPAPKNLVVSRVTEDSARLSWVDKRHPDFDS FLIQYQESEKVGEAIVLTVSGSERSYDLTGLK PGTEYTVSIYGVHGFLQWYWSTSNPLSAIFTT |
| 1118 | PRT | Artificial | Luk988 Hla binding FN3 domain | LPAPKNLVVSRVTEDSARLSWAPSHFPRSFDS FLIQYQESEKVGEAIVLTVPGSERSYDLTGLK PGTEYTVSIYGVLTVATIRWQSDPLSAIFTT |
| 1119 | PRT | Artificial | Luk989 Hla binding FN3 domain | LPAPKNLFVSRVTEDSARLSWTAPDAAFDSF FIRYVEYGQPGEAIPLDVPGSERSYDLTGLKP GTEYGVSINGVKGGNRSSPLFARFTT |
| 1120 | PRT | Artificial | Luk990 Hla binding FN3 domain | LPAPKNLVVSRVTEDSARLSWTAPDAAFDSF SISYKEWWAVGEAIFLHVPGSERSYDLTGLK PGTEYHVPISGVKGGDKSLPAHFTT |
| 1121 | PRT | Artificial | Luk991 Hla binding FN3 domain | LPAPKNLVVSRVTEDSARLSWTAPDAAFDSF GIHYGELWWNGEAIALVVPGSERSYDLTGLK PGTEYKVWIPGVKGGSQSKPLWAFFTT |
| 1122 | PRT | Artificial | Luk992 Hla binding FN3 domain | LPAPKNLVVSRVTEDSARLSWTAPDAAFDSF YIYYVEKPDPGEAIELYVPGSERSYDLTGLKP GTEYRVRIEGVKGGDHSFPPLVAGFTT |
| 1123 | PRT | Artificial | Luk993 Hla binding FN3 domain | LPAPKNLVVSRVTEDSARLSWTAPDAAFDSFI IEYWEERQRGEAIGLTVPGSERSYDLTGLKPG TEYRVIIVGVKGGTYSVPLEAFFTT |
| 1124 | PRT | Artificial | Luk994 Hla binding FN3 domain | LPAPKNLVVSRVTEDSARLSWTAPDAAFDSF GIEYHEPSKWGEAIGLNVPGSERSYDLTGLKP GTEYSVQIKGVKGGWWSHPLPAAFTT |
| 1125 | PRT | Artificial | Luk995 Hla binding FN3 domain | LPAPKNLVVSRVTEDSARLSWTAPDAAFDSF YIKYGEGNHGEAIWLFVPGSERSYDLTGLKP GTEYVVEIVGVKGGFPSQPLHAQFTT |
| 1126 | PRT | Artificial | Luk996 Hla binding FN3 domain | LPAPKNLVVSRVTEDSARLSWTAPDAAFDSF KIDYIEIDVEGEAIYLFVPGSERSYDLTGLKPG TEFRVRIPGVKGGDHSVPLAAAFTT |
| 1127 | PRT | Artificial | Luk997 Hla binding FN3 domain | LPAPKNLVVSRVTEDSARLSWTAPDAAFDSFI ISYPEYWAIGEAIPLFVPGSERSYDLTGLKPGT EYIVIIPGVKGGKGSNPLWAIFTT |

TABLE 6-continued

Nucleic Acid and Amino Acid Sequences of the Disclosure

| SEQ ID NO: | Type | Species | Description | Sequence |
|---|---|---|---|---|
| 1128 | PRT | Artificial | Luk998 Hla binding FN3 domain | LPAPKNLVVSRVTEDSARLSWTAPDAAFDSF EIGYFAEVDPGEAIQLDVPGSERSYDLTGLKP GTEYAVNIPGVKGGYKSDPLNAHSTT |
| 1129 | PRT | Artificial | Luk999 Hla binding FN3 domain | LPAPKNLVVSRVTEDSVRLSWTAPDAAFDSF DIPYQELNRKGEAIQLTVPGSESSYDLTGLKP GTEYKVHIRGVKGGKQSLPLIAGFTT |
| 1130 | PRT | Artificial | Luk1000 Hla binding FN3 domain | LPAPKNLVVSRVTEDSARLSWTAPDAAFDSF EITYHEIYKFGEAITLQVPGSERSYDLTGLKPG TEYRVRITGVKGGWKSQPLVAKFTT |
| 1131 | PRT | Artificial | Luk1001 Hla binding FN3 domain | LPAPKNLVVSRVTEDSARLSWTAPDAAFDSF DIRYDEEGYWGEAIPLHVPGSERSYDLTGLK PGTEYTVWIYGVKGGRKSVPLVAEFTT |
| 1132 | PRT | Artificial | Luk1002 Hla binding FN3 domain | LPAPKNLVVSRVTEDSARLSWTAPDAAFDSF NIRYKEPHRQGEAIPLIVPGSERSYDLTGLKP GTEYNVHIHGVKGGKWSIPLYAWFTT |
| 1133 | PRT | Artificial | Luk1003 Hla binding FN3 domain | LPAPKNLVVSRVTEDSARLSWTAPDAAFDSF DISYWEQVWQGEAIVLVVPGSERSYDLTGLK PGTEYPVFIRGVKGGSQSGPLRAFFTT |
| 1134 | PRT | Artificial | Luk1004 Hla binding FN3 domain | LPAPKNLVVSRVTEDSARLSWTAPDAAFDSF YIYYYEFFRNGEAIVLFVPGSERSYDLTGLKP GTEYWVRIKGVKGGRDSHPLYAGFTT |
| 1135 | PRT | Artificial | Luk1005 Hla binding FN3 domain | LPAPKNLVVSRVTEDSARLSWTAPDAAFDSF SIGYHEVQQTGEAIRLFVPGSERSYDLTGLKP GTEYEVEIRGVKGGTTSIPLWAHFTT |
| 1136 | PRT | Artificial | Luk1006 Hla binding FN3 domain | LPAPKNLVVSRVTEDSARLSWTAPDAAFDSF GITYEEPHEIGEAIFLVVPGSERSYDLTGLKPG TEYYVEIQGVKGGDPSDPLNAAFTT |
| 1137 | PRT | Artificial | Luk1007 Hla binding FN3 domain | LPAPKNLVVSRVTEDSARLSWTAPDAAFDSF AIHYREWSIWGEAIDLVVPGSERSYDLTGLKP GTEYIVIIPGVKGGYVSNPLFAFFTTT |
| 1138 | PRT | Artificial | Luk1008 Hla binding FN3 domain | LPAPKNLVVSRVTEDSARLSWTAPDAAFDSF HIYYSERQRIGEAIILVVPGSERSYDLTGLKPG TEYIVKINGVKGGIISQPLIAPFTT |
| 1139 | PRT | Artificial | Luk1009 Hla binding FN3 domain | LPAPKNLVVSRVTEDSARLSWTAPDAAFDSF NITYVEPVTEGEAISLVVPGSERSYDLTGLKP GTEYSVKIHGVKGGPASNPLYAKFTT |
| 1140 | PRT | Artificial | Luk1010 Hla binding FN3 domain | LPAPKNLVVSRVTEDSARLSWTAPDAAFDSF KIKYKEERHIGEAIHLGVPGSERSYDLTGLKP GTEYEVYIVGVKGGSSSSPLFAHFTT |
| 1141 | PRT | Artificial | Luk1011 Hla binding FN3 domain | LPAPKNLVVSRVTEDSARLSWTAPDAAFDSF RITYWEDNSTGEAILLVVPGSERSYDLTGLKP GTEYRVAIVGVKGGDDSWPLLATFTT |
| 1142 | PRT | Artificial | Luk1012 Hla binding FN3 domain | LPAPKNLVVSRVTEDSARLSWTAPDAAFDSF FILYVEYSVNGEAIELSVPGSERSYDLTGLKP GTEYDVIIGGVKGGNHSKPLVAFFTT |
| 1143 | PRT | Artificial | Luk1013 Hla binding FN3 domain | LPAPKNLVVSRVTEDSARLSWTAPDAAFDSF AIHYREWFIWGEAIDLVVPGSERSYDLTGLKP GTEYIVIIPGVKGGYVSNPLFAFFTT |
| 1144 | PRT | Artificial | Luk1014 Hla binding FN3 domain | LPAPKNLVVSRVTEDSARLSWTAPDAAFDSF GIGYRELGGLGEAIVLTVPGSERSYDLTGLKP GTEYYVVIPGVKGGGLSLPLSAIFTT |
| 1145 | PRT | Artificial | Luk1015 Hla binding FN3 domain | LPAPKNLVVSRVTEDSARLSWTALDAAFDSF GIPYRELGRGGEAIVLTVPGSERSYDLTGLKP GTEYVVYITGVKGGMISTPLSAIFTT |

TABLE 6-continued

Nucleic Acid and Amino Acid Sequences of the Disclosure

| SEQ ID NO: | Type | Species | Description | Sequence |
|---|---|---|---|---|
| 1146 | PRT | Artificial | Luk1016 Hla binding FN3 domain | LPAPKNLVVSRVTEDSARLSWTAPDAAFDSF GIPYRELGRGGEAIVLTVPGSERSYDLTGLKP GTEYVVYITGVKGGMISTPLSAIFTT |
| 1147 | PRT | Artificial | Luk1017 Hla binding FN3 domain | LPAPKNLVVSRVTEDSARLSWTAPDAAFDSF WIHYREVPVPGEAIVLTVPGSERSYDLTGLKP GTEYFVYIMGVKGGTFSAPLSAIFTT |
| 1148 | PRT | Artificial | Luk1018 Hla binding FN3 domain | LPAPKNLVVSRVTEDSACLSWTAPDAAFDSF GIPYRELGRGGEAIVLTVPGSERSYDLTGLKP GTEYVVYITGVKGGMISTPLSAIFTT |
| 1149 | PRT | Artificial | LukA mut1 | MNSAHHHHHHHHHGGGLNDIFEAQKIEWH EGSHKDSQDQNKKEHVDKSQQKDKRNVTN KDKNSTAPDDIGKNGKITKRTETVYDEKTNIL QNLQFDFIDDPTYDKNVLLVKKQGSIHSNLK FESHKEEKNSNWLKYPSEYHVDFQVKRNRK TEILDQLPKNKISTAKVDSTFKFDSTKGIGRTS SNSYSKTISYNQQNYDTIASGKNNNWHVHW SVIANDLKYGGEVKNRNDELLFYRNTRIATV ENPELSFASKYRYPALVRSGFNPEFLTYLSNE KSNEKTQFEVTYTRNQDILKNRPGIHYAPPIL EKNKDGQRLIVTYEVDWKNKTVKVVDKYS DDNKPYKAG |
| 1150 | PRT | Artificial | LukB mut1 | MKINSEIKQVSEKNLDGDTKMYTRTATTSDS QKNITQSLQFNFLTEPNYDKETVFIKAKGTIG SGLRILDPNGYWNSTLRWPGSYSVSIQNVDD NNNTNVTDFAPKNQDESREVKYTYGYKTIN RGGLTGNITKESNYSETISYQQPSYRTLLDQS TSHKGVGWKVEAHLINNMGHDHTRQLTNDS DNRTKSEIFSLTRNGNLWAKDNFTPKDKMPV TVSEGFNPEFLAVMSHDKKDKGKSQFVVHY KRSMDEFKIDWNRHGFWGYWSGENHVDKK EEKLSALYEVDWKTHNVKFVKVLNDNEKK |
| 1151 | PRT | Artificial | LukB mut2 | MKINSEIKQVSEKNLDGDTKMYTRTATTSDS QKNITQSLQFNFLTEPNYDKETVFIKAKGTIG SGLRILDPNGYWNSTLRWPGSYSVSIQNVDD NNNTNVTDFAPKNQDESREVKYTYGYKTGG DFSINRNITKESNYSETISYQQPSYRTLLDQST SHKGVGWKVEAHLINNMGHDHTRQLTNDS DNRTKSEIFSLTRNGNLWAKDNFTPKDKMPV TVSEGFNPEFLAVMSHDKKDKGKSQFVVHY KRSMDEFKIDWNRHGFWGYWSGENHVDKK EEKLSALYEVDWKTHNVKFVKVLNDNEKK |
| 1152 | PRT | Artificial | TENCON_HIS_SA | MLPAPKNLVVSRVTEDSARLSWTAPDAAFDS FLIQYQESEKVGEAIVLTVPGSERSYDLTGLK PGTEYTVSIYGVKGGHRSNPLSAIFTTGGHHH HHHGGGLNDIFEAQKIEWHE |
| 1153 | PRT | Artificial | Luk17_HIS_SA | MLPAPKNLVVSRVTEDSARLSWTAPDAAFDS FWITYEEKFYRGEAIVLTVPGSERSYDLTGLK PGTEYKVWIVGVKGGQGSWPLSAIFTTGGHH HHHHGGGLNDIFEAQKIEWHE |
| 1154 | PRT | Artificial | Luk19_HIS_SA | MLPAPKNLVVSRVTEDSARLSWYHAIHRLN HFDSFLIQYQESEKVGEAIVLTVPGSERSYDL AGLKPGTEYTVSIYGVLPDAFVSSNPLSAIFTT GGHHHHHHGGGLNDIFEAQKIEWHE |
| 1155 | PRT | Artificial | Luk26_HIS_SA | MLPAPKNLVVSRVTEDSARLSWTAPDAAFDS FHIEYAEPWVWGEAIVLTVPGSERSYDLTGL KPGTEYVVFIGGVKGGHNSTPLSAIFTTGGHH HHHHGGGLNDIFEAQKIEWHE |
| 1156 | PRT | Artificial | Luk31_HIS_SA | MLPAPNNLVVSRVTEDSARLSWDWDKYYTN RFDSFLIQYQESEKVGEAIVLTVPGSERSYDL TGLKPGTEYTVSIYGVLVRDYIRAAEWYSNP LSAIFTTGGHHHHHHGGGLNDIFEAQKIEWHE |
| 1157 | PRT | Artificial | Luk32_HIS_SA | MLPAPKNLVVSRVTEDSARLSWYHENAYLL FDSFLIQYQESEKVGEAIVLTVPGSERSYDLT |

TABLE 6-continued

Nucleic Acid and Amino Acid Sequences of the Disclosure

| SEQ ID NO: | Type | Species | Description | Sequence |
|---|---|---|---|---|
| | | | | GLKPGTEYTVSIYGVVYDLTPEKRSSNPLSAI FTTGGHHHHHGGGLNDIFEAQKIEWHE |
| 1158 | PRT | Artificial | Luk163_HIS_SA | MLPAPKNLVVSRVTEDSARLSWTAPDAAFDS FYIEYWEPTSDGEAIALNVPGSERSYDLTGLK PGTEYFVEIWGVKGGPRSPPLSAWFTTGGHH HHHHGGGLNDIFEAQKIEWHE |
| 1159 | PRT | Artificial | Luk174_HIS_SA | MLPAPKNLVVSRVTEDSARLSWTAPDAAFDS FDIEYGEPEKIGEAIWLTVPGSERSYDLTGLK PGTEYWVFIYGVKGGALSRPLTATFTTGGHH HHHHGGGLNDIFEAQKIEWHE |
| 1160 | PRT | Artificial | Luk187_HIS_SA | MLPAPKNLVVSRVTEDSARLSWTAPDAAFDS FRILYFEYKRLGEAIVLTVPGSERSYDLTGLK PGTEYFVGIHGVKGGYISRPLSAIFTTGGHHH HHHGGGLNDIFEAQKIEWHE |
| 1161 | PRT | Artificial | Luk188_HIS_SA | MLPAPKNLVVSRVTEDSARLSWTAPDAAFDS FHIHYWEFNPAGEAIVLTVPGSERSYDLTGLK PGTEYFVGIHGVKGGGISWPLSAIFTTGGHHH HHHGGGLNDIFEAQKIEWHE |
| 1162 | PRT | Artificial | Luk311_HIS_SA | MLPAPKNLVVSRVTEDSARLSWTAPDAAFDS FWISYVEPDDGEAIELLVPGSERSYDLTGLKP GTEYIVQIDGVKGGTTSVPLNARFTTGGHHH HHHGGGLNDIFEAQKIEWHE |
| 1163 | PRT | Artificial | HC431 | QVQLQQSGAELMNPGASVKISCKSTGYKFSS YWIEWVKQRPGHGLEWMGEILPGSGSTNHN EKFKGKAIFTADASSNTAYMELSSLTSEDSAV YYCARTISTATDWFAYWGQGTLVTVSAAST KGPSVFPLAPSSKSTSGGTAALGCLVKDYFPE PVTVSWNSGALTSGVHTFPAVLQSSGLYSLS SVVTVPSSSLGTQTYICNVNHKPSNTKVDKK VEPKSCDKTHTCPPCPAPPVAGPDVFLFPPKP KDTLMISRTPEVTCVVVDVSHEDPEVKFNWY VDGVEVHNAKTKPREEQYNSTYRVVSVLTV LHQDWLNGKEYKCKVSNAALPAPIAKTISKA KGQPREPQVYTLPPSRDELTKNQVSLTCLVK GFYPSDIAVEWESNGQPENNYKTTPPVLDSD GSFFLYSKLTVDKSRWQQGNVFSCSVMHEA LHNRFTQKSLSLSPGKGGGGSGGGGSGGGGS GGGGSMLPAPKNLVVSRVTEDSARLSWTAP DAAFDSFWITYEEKFYRGEAIVLTVPGSERSY DLTGLKPGTEYKVWIVGVKGGQGSWPLSAIF TT |
| 1164 | PRT | Artificial | LC431 | DVLMTQTPLSLPVSLGDQASISCRSSQTIVYS DGNTYLEWYLQKPGQSPKLLIYKVSNRFSGV PDRVSGSGSGTDFTLKISRVEAEDLGVYYCF QGSHVPYTFGGGTKLEIKRTVAAPSVFIFPPS DEQLKSGTASVVCLLNNFYPREAKVQWKVD NALQSGNSQESVTEQDSKDSTYSLSSTLTLSK ADYEKHKVYACEVTHQGLSSPVTKSFNRGEC |
| 1165 | PRT | Artificial | HC432 | EVQLQQSGGGLVKPGGSLKLSCAASGFTFSS YAMSWVRQTPEKRLEWVATITGGGTYTYYL DSVKGRFTISRDNAKTSLYLQMSSLRSEDTA MYYCARHRDGNYGCFDVWGAGTTVTVSSA STKGPSVFPLAPSSKSTSGGTAALGCLVKDYF PEPVTVSWNSGALTSGVHTFPAVLQSSGLYS LSSVVTVPSSSLGTQTYICNVNHKPSNTKVDK KVEPKSCDKTHTCPPCPAPPVAGPDVFLFPPK PKDTLMISRTPEVTCVVVDVSHEDPEVKFNW YVDGVEVHNAKTKPREEQYNSTYRVVSVLT VLHQDWLNGKEYKCKVSNAALPAPIAKTISK AKGQPREPQVYTLPPSRDELTKNQVSLTCLV KGFYPSDIAVEWESNGQPENNYKTTPPVLDS DGSFFLYSKLTVDKSRWQQGNVFSCSVMHE ALHNRFTQKSLSLSPGKGGGGSGGGGSGGG GSGGGGSMLPAPKNLVVSRVTEDSARLSWT APDAAFDSFWITYEEKFYRGEAIVLTVPGSER SYDLTGLKPGTEYKVWIVGVKGGQGSWPLS AIFTT |

TABLE 6-continued

Nucleic Acid and Amino Acid Sequences of the Disclosure

| SEQ ID NO: | Type | Species | Description | Sequence |
| --- | --- | --- | --- | --- |
| 1166 | PRT | Artificial | LC432 | DIVLTQSPAIMSASLGERVTMTCTASSSVSSS YLHWYQQKPGSSPKLWVYSTSNLASGVPAR FSGSGSGSSYSLTISSMEPEDTATYYCHQYHR SPQTFGGGTKLEIKRTVAAPSVFIFPPSDEQLK SGTASVVCLLNNFYPREAKVQWKVDNALQS GNSQESVTEQDSKDSTYSLSSTLTLSKADYEK HKVYACEVTHQGLSSPVTKSFNRGEC |
| 1167 | PRT | Artificial | HC505 | QVQLQQSGAELMNPGASVKISCKSTGYKFSS YWIEWVKQRPGHGLEWMGEILPGSGSTNHN EKFKGKAIFTADASSNTAYMELSSLTSEDSAV YYCARTISTATDWFAYWGQGTLVTVSAAST KGPSVFPLAPSSKSTSGGTAALGCLVKDYFPE PVTVSWNSGALTSGVHTFPAVLQSSGLYSLS SVVTVPSSSLGTQTYICNVNHKPSNTKVDKK VEPKSCDKTHTCPPCPAPPVAGPDVFLFPPKP KDTLMISRTPEVTCVVVDVSHEDPEVKFNWY VDGVEVHNAKTKPREEQYNSTYRVVSVLTV LHQDWLNGKEYKCKVSNAALPAPIAKTISKA KGQPREPQVYTLPPSRDELTKNQVSLTCLVK GFYPSDIAVEWESNGQPENNYKTTPPVLDSD GSFFLYSKLTVDKSRWQQGNVFSCSVMHEA LHNHYTQKSLSLSPGKGGGGSGGGGSGGGG SGGGGSMLPAPKNLVVSRVTEDSARLSWTAP DAAFDSFWITYEEKFYRGEAIVLTVPGSERSY DLTGLKPGTEYKVWIVGVKGGQGSWPLSAIF TT |
| 1168 | PRT | Artificial | LC505 | DVLMTQTPLSLPVSLGDQASISCRSSQTIVYS DGNTYLEWYLQKPGQSPKLLIYKVSNRFSGV PDRVSGSGSGTDFTLKISRVEAEDLGVYYCF QGSHVPYTFGGGTKLEIKRTVAAPSVFIFPPS DEQLKSGTASVVCLLNNFYPREAKVQWKVD NALQSGNSQESVTEQDSKDSTYSLSSTLTLSK ADYEKHKVYACEVTHQGLSSPVTKSFNRGEC |
| 1169 | PRT | Artificial | HC506 | EVQLQQSGGGLVKPGGSLKLSCAASGFTFSS YAMSWVRQTPEKRLEWVATITGGGTYTYYL DSVKGRFTISRDNAKTSLYLQMSSLRSEDTA MYYCARHRDGNYGCFDVWGAGTTVTVSSA STKGPSVFPLAPSSKSTSGGTAALGCLVKDYF PEPVTVSWNSGALTSGVHTFPAVLQSSGLYS LSSVVTVPSSSLGTQTYICNVNHKPSNTKVDK KVEPKSCDKTHTCPPCPAPPVAGPDVFLFPPK PKDTLMISRTPEVTCVVVDVSHEDPEVKFNW YVDGVEVHNAKTKPREEQYNSTYRVVSVLT VLHQDWLNGKEYKCKVSNAALPAPIAKTISK AKGQPREPQVYTLPPSRDELTKNQVSLTCLV KGFYPSDIAVEWESNGQPENNYKTTPPVLDS DGSFFLYSKLTVDKSRWQQGNVFSCSVMHE ALHNHYTQKSLSLSPGKGGGGSGGGGSGGGG GSGGGGSMLPAPKNLVVSRVTEDSARLSWT APDAAFDSFWITYEEKFYRGEAIVLTVPGSER SYDLTGLKPGTEYKVWIVGVKGGQGSWPLS AIFTT |
| 1170 | PRT | Artificial | LC506 | DIVLTQSPAIMSASLGERVTMTCTASSSVSSS YLHWYQQKPGSSPKLWVYSTSNLASGVPAR FSGSGSGSSYSLTISSMEPEDTATYYCHQYHR SPQTFGGGTKLEIKRTVAAPSVFIFPPSDEQLK SGTASVVCLLNNFYPREAKVQWKVDNALQS GNSQESVTEQDSKDSTYSLSSTLTLSKADYEK HKVYACEVTHQGLSSPVTKSFNRGEC |
| 1171 | PRT | Artificial | Luk047001 (SAFN3-TENCON) | MLPAPKNLVVSRVTEDSARLSWTAPDAAFDS FHIEYWEQSIVGEAIVLTVPGSERSYDLTGLK PGTEYRVWIYGVKGGNDSWPLSAIFTTGGGG SGGGGSGGGGSGGGGSMLPAPKNLVVSRVT EDSARLSWTAPDAAFDSFLIQYQESEKVGEAI VLTVPGSERSYDLTGLKPGTEYTVSIYGVKG GHRSNPLSAIFTTGGHHHHHH |

TABLE 6-continued

Nucleic Acid and Amino Acid Sequences of the Disclosure

| SEQ ID NO: | Type | Species | Description | Sequence |
|---|---|---|---|---|
| 1172 | PRT | Artificial | Luk047002 (SABD-TENCON) | MTIDEWLLKEAKEKAIEELKKAGITSDYYFD LINKAKTVEGVNALKDEILKAGGGGSGGGGS GGGGSGGGGSMLPAPKNLVVSRVTEDSARL SWTAPDAAFDSFLIQYQESEKVGEAIVLTVPG SERSYDLTGLKPGTEYTVSIYGVKGGHRSNP LSAIFTTGGHHHHHH |
| 1173 | PRT | Artificial | Luk047003 (TFFN3-TENCON) | MLPAPKNLVVSRVTEDSARLSWTAPDAAFDS FAIEYEELRDWGEAIVLTVPGSERSYDLTGLK PGTEYSVSITGVKGGAESWPLSAIFTTGGGGS GGGGSGGGGSGGGGSMLPAPKNLVVSRVTE DSARLSWTAPDAAFDSFLIQYQESEKVGEAIV LTVPGSERSYDLTGLKPGTEYTVSIYGVKGG HRSNPLSAIFTTGGHHHHHH |
| 1174 | PRT | Artificial | Luk047004 (SAFN3-LukE26) | MLPAPKNLVVSRVTEDSARLSWTAPDAAFDS FHIEYWEQSIVGEAIVLTVPGSERSYDLTGLK PGTEYRVWIYGVKGGNDSWPLSAIFTTGGGG SGGGGSGGGGSMLPAPKNLVVSRVT EDSARLSWTAPDAAFDSFHIEYAEPWVWGE AIVLTVPGSERSYDLTGLKPGTEYVVFIGGVK GGHNSTPLSAIFTTGGHHHHHH |
| 1175 | PRT | Artificial | Luk047005 (SABD-LukE26) | MTIDEWLLKEAKEKAIEELKKAGITSDYYFD LINKAKTVEGVNALKDEILKAGGGGSGGGGS GGGGSGGGGSMLPAPKNLVVSRVTEDSARL SWTAPDAAFDSFHIEYAEPWVWGEAIVLTVP GSERSYDLTGLKPGTEYVVFIGGVKGGHNST PLSAIFTTGGHHHHHH |
| 1176 | PRT | Artificial | Luk047006 (TFFN3-LukE26) | MLPAPKNLVVSRVTEDSARLSWTAPDAAFDS FAIEYEELRDWGEAIVLTVPGSERSYDLTGLK PGTEYSVSITGVKGGAESWPLSAIFTTGGGGS GGGGSGGGGSGGGGSMLPAPKNLVVSRVTE DSARLSWTAPDAAFDSFHIEYAEPWVWGEAI VLTVPGSERSYDLTGLKPGTEYVVFIGGVKG GHNSTPLSAIFTTGGHHHHHH |
| 1177 | PRT | Artificial | TENCON_HIS | MLPAPKNLVVSRVTEDSARLSWTAPDAAFDS FLIQYQESEKVGEAIVLTVPGSERSYDLTGLK PGTEYTVSIYGVKGGHRSNPLSAIFTTGGHHH HHH |
| 1178 | PRT | Artificial | Luk047007 | MLPAPKNLVVSRVTEDSARLSWTAPDAAFDS FHIEYWEQSIVGEAIVLTVPGSERSYDLTGLK PGTEYRVWIYGVKGGNDSWPLSAIFTTGGGG SGGGGSGGGGSGGGGSMLPAPKNLVVSRVT EDSARLSWTAPDAAFDSFWITYEEKFYRGEA IVLTVPGSERSYDLTGLKPGTEYKVWIVGVK GGQGSWPLSAIFTTGGHHHHHH |
| 1179 | PRT | Artificial | Luk047008 | MTIDEWLLKEAKEKAIEELKKAGITSDYYFD LINKAKTVEGVNALKDEILKAGGGGSGGGGS GGGGSGGGGSMLPAPKNLVVSRVTEDSARL SWTAPDAAFDSFWITYEEKFYRGEAIVLTVP GSERSYDLTGLKPGTEYKVWIVGVKGGQGS WPLSAIFTTGGHHHHHH |
| 1180 | PRT | Artificial | Luk047009 | MLPAPKNLVVSRVTEDSARLSWTAPDAAFDS FAIEYEELRDWGEAIVLTVPGSERSYDLTGLK PGTEYSVSITGVKGGAESWPLSAIFTTGGGGS GGGGSGGGGSGGGGSMLPAPKNLVVSRVTE DSARLSWTAPDAAFDSFWITYEEKFYRGEAI VLTVPGSERSYDLTGLKPGTEYKVWIVGVKG GQGSWPLSAIFTTGGHHHHHH |
| 1181 | PRT | Artificial | Luk047010 | MLPAPKNLVVSRVTEDSARLSWTAPDAAFDS FHIEYWEQSIVGEAIVLTVPGSERSYDLTGLK PGTEYRVWIYGVKGGNDSWPLSAIFTTGGGG SGGGGSGGGGSMLPAPKNLVVSRVT EDSARLSWYHAIHRLNHFDSFLIQYQESEKV GEAIVLTVPGSERSYDLAGLKPGTEYTVSIYG VLPDAFVSSNPLSAIFTTGGHHHHHH |

TABLE 6-continued

Nucleic Acid and Amino Acid Sequences of the Disclosure

| SEQ ID NO: | Type | Species | Description | Sequence |
|---|---|---|---|---|
| 1182 | PRT | Artificial | Luk047011 | MTIDEWLLKEAKEKAIEELKKAGITSDYYFD<br>LINKAKTVEGVNALKDEILKAGGGGSGGGGS<br>GGGGSGGGGSMLPAPKNLVVSRVTEDSARL<br>SWYHAIHRLNHFDSFLIQYQESEKVGEAIVLT<br>VPGSERSYDLAGLKPGTEYTVSIYGVLPDAF<br>VSSNPLSAIFTTGGHHHHHH |
| 1183 | PRT | Artificial | Luk047012 | MLPAPKNLVVSRVTEDSARLSWTAPDAAFDS<br>FAIEYEELRDWGEAIVLTVPGSERSYDLTGLK<br>PGTEYSVSITGVKGGAESWPLSAIFTTGGGGS<br>GGGGSGGGGSGGGGSMLPAPKNLVVSRVTE<br>DSARLSWYHAIHRLNHFDSFLIQYQESEKVG<br>EAIVLTVPGSERSYDLAGLKPGTEYTVSIYGV<br>LPDAFVSSNPLSAIFTTGGHHHHHH |
| 1184 | PRT | Artificial | Luk047013 | MLPAPKNLVVSRVTEDSARLSWTAPDAAFDS<br>FHIEYWEQSIVGEAIVLTVPGSERSYDLTGLK<br>PGTEYRVWIYGVKGGNDSWPLSAIFTTGGGG<br>SGGGGSGGGGSGGGGSMLPAPKNLVVSRVT<br>EDSARLSWTAPDAAFDSFPIVYQEWQFYGEA<br>IVLTVPGSERSYDLTGLKPGTEYLVDIYGVKG<br>GSWSYPLSAIFTTGGHHHHHH |
| 1185 | PRT | Artificial | Luk047014 | MTIDEWLLKEAKEKAIEELKKAGITSDYYFD<br>LINKAKTVEGVNALKDEILKAGGGGSGGGGS<br>GGGGSGGGGSMLPAPKNLVVSRVTEDSARL<br>SWTAPDAAFDSFPIVYQEWQFYGEAIVLTVP<br>GSERSYDLTGLKPGTEYLVDIYGVKGGSWSY<br>PLSAIFTTGGHHHHHH |
| 1186 | PRT | Artificial | Luk047015 | MLPAPKNLVVSRVTEDSARLSWTAPDAAFDS<br>FAIEYEELRDWGEAIVLTVPGSERSYDLTGLK<br>PGTEYSVSITGVKGGAESWPLSAIFTTGGGGS<br>GGGGSGGGGSGGGGSMLPAPKNLVVSRVTE<br>DSARLSWTAPDAAFDSFPIVYQEWQFYGEAI<br>VLTVPGSERSYDLTGLKPGTEYLVDIYGVKG<br>GSWSYPLSAIFTTGGHHHHHH |
| 1187 | PRT | Artificial | Luk047016 | MLPAPKNLVVSRVTEDSARLSWTAPDAAFDS<br>FHIEYWEQSIVGEAIVLTVPGSERSYDLTGLK<br>PGTEYRVWIYGVKGGNDSWPLSAIFTTGGGG<br>SGGGGSGGGGSGGGGSMLPAPNNLVVSRVT<br>EDSARLSWDWDKYYTNRFDSFLIQYQESEKV<br>GEAIVLTVPGSERSYDLTGLKPGTEYTVSIYG<br>VLVRDYIRAAEWYSNPLSAIFTTGGHHHHHH |
| 1188 | PRT | Artificial | Luk047017 | MTIDEWLLKEAKEKAIEELKKAGITSDYYFD<br>LINKAKTVEGVNALKDEILKAGGGGSGGGGS<br>GGGGSGGGGSMLPAPNNLVVSRVTEDSARL<br>SWDWDKYYTNRFDSFLIQYQESEKVGEAIVL<br>TVPGSERSYDLTGLKPGTEYTVSIYGVLVRD<br>YIRAAEWYSNPLSAIFTTGGHHHHHH |
| 1189 | PRT | Artificial | Luk047018 | MLPAPKNLVVSRVTEDSARLSWTAPDAAFDS<br>FAIEYEELRDWGEAIVLTVPGSERSYDLTGLK<br>PGTEYSVSITGVKGGAESWPLSAIFTTGGGGS<br>GGGGSGGGGSGGGGSMLPAPNNLVVSRVTE<br>DSARLSWDWDKYYTNRFDSFLIQYQESEKV<br>GEAIVLTVPGSERSYDLTGLKPGTEYTVSIYG<br>VLVRDYIRAAEWYSNPLSAIFTTGGHHHHHH |
| 1190 | PRT | Artificial | Luk047019 | MLPAPKNLVVSRVTEDSARLSWTAPDAAFDS<br>FHIEYWEQSIVGEAIVLTVPGSERSYDLTGLK<br>PGTEYRVWIYGVKGGNDSWPLSAIFTTGGGG<br>SGGGGSGGGGSGGGGSMLPAPKNLVVSRVT<br>EDSARLSWYHENAYLLFDSFLIQYQESEKVG<br>EAIVLTVPGSERSYDLTGLKPGTEYTVSIYGV<br>VYDLTPEKRSSNPLSAIFTTGGHHHHHH |
| 1191 | PRT | Artificial | Luk047020 | MTIDEWLLKEAKEKAIEELKKAGITSDYYFD<br>LINKAKTVEGVNALKDEILKAGGGGSGGGGS<br>GGGGSGGGGSMLPAPKNLVVSRVTEDSARL<br>SWYHENAYLLFDSFLIQYQESEKVGEAIVLT<br>VPGSERSYDLTGLKPGTEYTVSIYGVVYDLTP<br>EKRSSNPLSAIFTTGGHHHHHH |

TABLE 6-continued

Nucleic Acid and Amino Acid Sequences of the Disclosure

| SEQ ID NO: | Type | Species | Description | Sequence |
|---|---|---|---|---|
| 1192 | PRT | Artificial | Luk047021 | MLPAPKNLVVSRVTEDSARLSWTAPDAAFDS FAIEYEELRDWGEAIVLTVPGSERSYDLTGLK PGTEYSVSITGVKGGAESWPLSAIFTTGGGGS GGGGSGGGGSGGGGSMLPAPKNLVVSRVTE DSARLSWYHENAYLLFDSFLIQYQESEKVGE AIVLTVPGSERSYDLTGLKPGTEYTVSIYGVV YDLTPEKRSSNPLSAIFTTGGHHHHHH |
| 1193 | PRT | Artificial | Luk047022 | MLPAPKNLVVSRVTEDSARLSWTAPDAAFDS FHIEYWEQSIVGEAIVLTVPGSERSYDLTGLK PGTEYRVWIYGVKGGNDSWPLSAIFTTGGGG SGGGGSGGGGSGGGGSMLPAPKNLVVSRVT EDSARLSWTAPDAAFDSFLIQYQESEKVGEAI VLTVPGSERSYDLTGLKPGTEYTVSIYGVELI YHGWLDFVFSNPLSAIFTTGGHHHHHH |
| 1194 | PRT | Artificial | Luk047023 | MTIDEWLLKEAKEKAIEELKKAGITSDYYFD LINKAKTVEGVNALKDEILKAGGGGSGGGGS GGGGSGGGGSMLPAPKNLVVSRVTEDSARL SWTAPDAAFDSFLIQYQESEKVGEAIVLTVPG SERSYDLTGLKPGTEYTVSIYGVELIYHGWL DFVFSNPLSAIFTTGGHHHHHH |
| 1195 | PRT | Artificial | Luk047024 | MLPAPKNLVVSRVTEDSARLSWTAPDAAFDS FAIEYEELRDWGEAIVLTVPGSERSYDLTGLK PGTEYSVSITGVKGGAESWPLSAIFTTGGGGS GGGGSGGGGSGGGGSMLPAPKNLVVSRVTE DSARLSWTAPDAAFDSFLIQYQESEKVGEAIV LTVPGSERSYDLTGLKPGTEYTVSIYGVELIY HGWLDFVFSNPLSAIFTTGGHHHHHH |
| 1196 | PRT | Artificial | Luk047025 | MLPAPKNLVVSRVTEDSARLSWTAPDAAFDS FHIEYWEQSIVGEAIVLTVPGSERSYDLTGLK PGTEYRVWIYGVKGGNDSWPLSAIFTTGGGG SGGGGSGGGGSGGGGSMLPAPKNLVVSRVT EDSARLSWTAPDAAFDSFYIEYWEPTSDGEAI ALNVPGSERSYDLTGLKPGTEYFVEIWGVKG GPRSPPLSAWFTTGGHHHHHH |
| 1197 | PRT | Artificial | Luk047026 | MTIDEWLLKEAKEKAIEELKKAGITSDYYFD LINKAKTVEGVNALKDEILKAGGGGSGGGGS GGGGSGGGGSMLPAPKNLVVSRVTEDSARL SWTAPDAAFDSFYIEYWEPTSDGEAIALNVP GSERSYDLTGLKPGTEYFVEIWGVKGGPRSP PLSAWFTTGGHHHHHH |
| 1198 | PRT | Artificial | Luk047027 | MLPAPKNLVVSRVTEDSARLSWTAPDAAFDS FAIEYEELRDWGEAIVLTVPGSERSYDLTGLK PGTEYSVSITGVKGGAESWPLSAIFTTGGGGS GGGGSGGGGSGGGGSMLPAPKNLVVSRVTE DSARLSWTAPDAAFDSFYIEYWEPTSDGEAI ALNVPGSERSYDLTGLKPGTEYFVEIWGVKG GPRSPPLSAWFTTGGHHHHHH |
| 1199 | PRT | Artificial | Luk047028 | MLPAPKNLVVSRVTEDSARLSWTAPDAAFDS FHIEYWEQSIVGEAIVLTVPGSERSYDLTGLK PGTEYRVWIYGVKGGNDSWPLSAIFTTGGGG SGGGGSGGGGSGGGGSMLPAPKNLVVSRVT EDSARLSWTAPDAAFDSFDIEYGEPEKIGEAI WLTVPGSERSYDLTGLKPGTEYWVFIYGVKG GALSRPLTATFTTGGHHHHHH |
| 1200 | PRT | Artificial | Luk047029 | MTIDEWLLKEAKEKAIEELKKAGITSDYYFD LINKAKTVEGVNALKDEILKAGGGGSGGGGS GGGGSGGGGSMLPAPKNLVVSRVTEDSARL SWTAPDAAFDSFDIEYGEPEKIGEAIWLTVPG SERSYDLTGLKPGTEYWVFIYGVKGGALSRP LTATFTTGGHHHHHH |
| 1201 | PRT | Artificial | Luk047030 | MLPAPKNLVVSRVTEDSARLSWTAPDAAFDS FAIEYEELRDWGEAIVLTVPGSERSYDLTGLK PGTEYSVSITGVKGGAESWPLSAIFTTGGGGS GGGGSGGGGSGGGGSMLPAPKNLVVSRVTE DSARLSWTAPDAAFDSFDIEYGEPEKIGEAIW |

TABLE 6-continued

Nucleic Acid and Amino Acid Sequences of the Disclosure

| SEQ ID NO: | Type | Species | Description | Sequence |
|---|---|---|---|---|
| | | | | LTVPGSERSYDLTGLKPGTEYWVFIYGVKGG ALSRPLTATFTTGGHHHHHH |
| 1202 | PRT | Artificial | Luk047031 | MLPAPKNLVVSRVTEDSARLSWTAPDAAFDS FHIEYWEQSIVGEAIVLTVPGSERSYDLTGLK PGTEYRVWIYGVKGGNDSWPLSAIFTTGGGG SGGGGSGGGGSGGGGSMLPAPKNLVVSRVT EDSARLSWTAPDAAFDSFRILYFEYKRLGEAI VLTVPGSERSYDLTGLKPGTEYFVGIHGVKG GYISRPLSAIFTTGGHHHHHH |
| 1203 | PRT | Artificial | Luk047032 | MTIDEWLLKEAKEKAIEELKKAGITSDYYFD LINKAKTVEGVNALKDEILKAGGGGSGGGGS GGGGSGGGGSMLPAPKNLVVSRVTEDSARL SWTAPDAAFDSFRILYFEYKRLGEAIVLTVPG SERSYDLTGLKPGTEYFVGIHGVKGGYISRPL SAIFTTGGHHHHHH |
| 1204 | PRT | Artificial | Luk047033 | MLPAPKNLVVSRVTEDSARLSWTAPDAAFDS FAIEYEELRDWGEAIVLTVPGSERSYDLTGLK PGTEYSVSITGVKGGAESWPLSAIFTTGGGGS GGGGSGGGGSGGGGSMLPAPKNLVVSRVTE DSARLSWTAPDAAFDSFRILYFEYKRLGEAIV LTVPGSERSYDLTGLKPGTEYFVGIHGVKGG YISRPLSAIFTTGGHHHHHH |
| 1205 | PRT | Artificial | Luk047034 | MLPAPKNLVVSRVTEDSARLSWTAPDAAFDS FHIEYWEQSIVGEAIVLTVPGSERSYDLTGLK PGTEYRVWIYGVKGGNDSWPLSAIFTTGGGG SGGGGSGGGGSGGGGSMLPAPKNLVVSRVT EDSARLSWTAPDAAFDSFHIHYWEFNPAGEA IVLTVPGSERSYDLTGLKPGTEYFVGIHGVKG GGISWPLSAIFTTGGHHHHHH |
| 1206 | PRT | Artificial | Luk047035 | MTIDEWLLKEAKEKAIEELKKAGITSDYYFD LINKAKTVEGVNALKDEILKAGGGGSGGGGS GGGGSGGGGSMLPAPKNLVVSRVTEDSARL SWTAPDAAFDSFHIHYWEFNPAGEAIVLTVP GSERSYDLTGLKPGTEYFVGIHGVKGGGISW PLSAIFTTGGHHHHHH |
| 1207 | PRT | Artificial | Luk047036 | MLPAPKNLVVSRVTEDSARLSWTAPDAAFDS FAIEYEELRDWGEAIVLTVPGSERSYDLTGLK PGTEYSVSITGVKGGAESWPLSAIFTTGGGGS GGGGSGGGGSGGGGSMLPAPKNLVVSRVTE DSARLSWTAPDAAFDSFHIHYWEFNPAGEAI VLTVPGSERSYDLTGLKPGTEYFVGIHGVKG GGISWPLSAIFTTGGHHHHHH |
| 1208 | PRT | Artificial | Luk047037 | MLPAPKNLVVSRVTEDSARLSWTAPDAAFDS FHIEYWEQSIVGEAIVLTVPGSERSYDLTGLK PGTEYRVWIYGVKGGNDSWPLSAIFTTGGGG SGGGGSGGGGSGGGGSMLPAPKNLVVSRVT EDSARLSWTAPDAAFDSFHIFYHETDAYGEAI VLTVPGSERSYDLTGLKPGTEYFVVIHGVKG GFISSPLSAIFTTGGHHHHHH |
| 1209 | PRT | Artificial | Luk047038 | MTIDEWLLKEAKEKAIEELKKAGITSDYYFD LINKAKTVEGVNALKDEILKAGGGGSGGGGS GGGGSGGGGSMLPAPKNLVVSRVTEDSARL SWTAPDAAFDSFHIFYHETDAYGEAIVLTVP GSERSYDLTGLKPGTEYFVVIHGVKGGFISSP LSAIFTTGGHHHHHH |
| 1210 | PRT | Artificial | Luk047039 | MLPAPKNLVVSRVTEDSARLSWTAPDAAFDS FAIEYEELRDWGEAIVLTVPGSERSYDLTGLK PGTEYSVSITGVKGGAESWPLSAIFTTGGGGS GGGGSGGGGSGGGGSMLPAPKNLVVSRVTE DSARLSWTAPDAAFDSFHIFYHETDAYGEAI VLTVPGSERSYDLTGLKPGTEYFVVIHGVKG GFISSPLSAIFTTGGHHHHHH |
| 1211 | PRT | Artificial | Luk047040 | MLPAPKNLVVSRVTEDSARLSWTAPDAAFDS FHIEYWEQSIVGEAIVLTVPGSERSYDLTGLK PGTEYRVWIYGVKGGNDSWPLSAIFTTGGGG |

TABLE 6-continued

Nucleic Acid and Amino Acid Sequences of the Disclosure

| SEQ ID NO: | Type | Species | Description | Sequence |
|---|---|---|---|---|
| | | | | SGGGGSGGGGSGGGGSMLPAPKNLVVSRVT EDSARLSWTAPDAAFDSFWISYVEPDDGEAI ELLVPGSERSYDLTGLKPGTEYIVQIDGVKGG TTSVPLNARFTTGGHHHHHH |
| 1212 | PRT | Artificial | Luk047041 | MTIDEWLLKEAKEKAIEELKKAGITSDYYFD LINKAKTVEGVNALKDEILKAGGGGSGGGGS GGGGSGGGGSMLPAPKNLVVSRVTEDSARL SWTAPDAAFDSFWISYVEPDDGEAIELLVPGS ERSYDLTGLKPGTEYIVQIDGVKGGTTSVPLN ARFTTGGHHHHHH |
| 1213 | PRT | Artificial | Luk047042 | MLPAPKNLVVSRVTEDSARLSWTAPDAAFDS FAIEYEELRDWGEAIVLTVPGSERSYDLTGLK PGTEYSVSITGVKGGAESWPLSAIFTTGGGGS GGGGSGGGGSGGGGSMLPAPKNLVVSRVTE DSARLSWTAPDAAFDSFWISYVEPDDGEAIE LLVPGSERSYDLTGLKPGTEYIVQIDGVKGGT TSVPLNARFTTGGHHHHHH |
| 1214 | PRT | Artificial | Luk047043 | MLPAPKNLVVSRVTEDSARLSWTAPDAAFDS FHIEYWEQSIVGEAIVLTVPGSERSYDLTGLK PGTEYRVWIYGVKGGNDSWPLSAIFTTGGGG SGGGGSGGGGSGGGGSMLPAPKNLVVSRVT EDSARLSWTAPDAAFDSFGIGYLEYPWYGEA IVLTVPGSERSYDLTGLKPGTEYFVDIYGVKG GWWSYPLSAIFTTGGHHHHHH |
| 1215 | PRT | Artificial | Luk047044 | MTIDEWLLKEAKEKAIEELKKAGITSDYYFD LINKAKTVEGVNALKDEILKAGGGGSGGGGS GGGGSGGGGSMLPAPKNLVVSRVTEDSARL SWTAPDAAFDSFGIGYLEYPWYGEAIVLTVP GSERSYDLTGLKPGTEYFVDIYGVKGGWWS YPLSAIFTTGGHHHHHH |
| 1216 | PRT | Artificial | Luk047045 | MLPAPKNLVVSRVTEDSARLSWTAPDAAFDS FAIEYEELRDWGEAIVLTVPGSERSYDLTGLK PGTEYSVSITGVKGGAESWPLSAIFTTGGGGS GGGGSGGGGSGGGGSMLPAPKNLVVSRVTE DSARLSWTAPDAAFDSFGIGYLEYPWYGEAI VLTVPGSERSYDLTGLKPGTEYFVDIYGVKG GWWSYPLSAIFTTGGHHHHHH |
| 1217 | PRT | Artificial | Luk047046 | MLPAPKNLVVSRVTEDSARLSWTAPDAAFDS FHIEYWEQSIVGEAIVLTVPGSERSYDLTGLK PGTEYRVWIYGVKGGNDSWPLSAIFTTGGGG SGGGGSGGGGSGGGGSMLPAPKNLVVSRVT EDSARLSWTAPDAAFDSFNIDYFEYYEFGEAI VLTVPGSERSYDLTGLKPGTEYFVDIYGVKG GSWSLPLSAIFTTGGHHHHHH |
| 1218 | PRT | Artificial | Luk047047 | MTIDEWLLKEAKEKAIEELKKAGITSDYYFD LINKAKTVEGVNALKDEILKAGGGGSGGGGS GGGGSGGGGSMLPAPKNLVVSRVTEDSARL SWTAPDAAFDSFNIDYFEYYEFGEAIVLTVPG SERSYDLTGLKPGTEYFVDIYGVKGGSWSLP LSAIFTTGGHHHHHH |
| 1219 | PRT | Artificial | Luk047048 | MLPAPKNLVVSRVTEDSARLSWTAPDAAFDS FAIEYEELRDWGEAIVLTVPGSERSYDLTGLK PGTEYSVSITGVKGGAESWPLSAIFTTGGGGS GGGGSGGGGSGGGGSMLPAPKNLVVSRVTE DSARLSWTAPDAAFDSFNIDYFEYYEFGEAIV LTVPGSERSYDLTGLKPGTEYFVDIYGVKGG SWSLPLSAIFTTGGHHHHHH |
| 1220 | PRT | Artificial | Luk047049 | MLPAPKNLVVSRVTEDSARLSWTAPDAAFDS FHIEYWEQSIVGEAIVLTVPGSERSYDLTGLK PGTEYRVWIYGVKGGNDSWPLSAIFTTGGGG SGGGGSGGGGSGGGGSMLPAPKNLVVSRVT EDSARLSWTAPDAAFDSFDISYDEYPEFGEAI VLTVPGSERSYDLTGLKPGTEYLVDIIGVKGG EISLPLSAIFTTGGHHHHHH |

TABLE 6-continued

Nucleic Acid and Amino Acid Sequences of the Disclosure

| SEQ ID NO: | Type | Species | Description | Sequence |
|---|---|---|---|---|
| 1221 | PRT | Artificial | Luk047050 | MTIDEWLLKEAKEKAIEELKKAGITSDYYFD LINKAKTVEGVNALKDEILKAGGGGSGGGGS GGGGSGGGGSMLPAPKNLVVSRVTEDSARL SWTAPDAAFDSFDISYDEYPEFGEAIVLTVPG SERSYDLTGLKPGTEYLVDIIGVKGGEISLPLS AIFTTGGHHHHHH |
| 1222 | PRT | Artificial | Luk047051 | MLPAPKNLVVSRVTEDSARLSWTAPDAAFDS FAIEYEELRDWGEAIVLTVPGSERSYDLTGLK PGTEYSVSITGVKGGAESWPLSAIFTTGGGGS GGGGSGGGGSGGGGSMLPAPKNLVVSRVTE DSARLSWTAPDAAFDSFDISYDEYPEFGEAIV LTVPGSERSYDLTGLKPGTEYLVDIIGVKGGE ISLPLSAIFTTGGHHHHHH |
| 1223 | PRT | Artificial | Luk047052 | MLPAPKNLVVSRVTEDSARLSWTAPDAAFDS FHIEYWEQSIVGEAIVLTVPGSERSYDLTGLK PGTEYRVWIYGVKGGNDSWPLSAIFTTGGGG SGGGGSGGGGSGGGGSMLPAPKNLVVSRVT EDSARLSWTAPDAAFDSFNIHYAEYPDFGEAI VLTVPGSERSYDLTGLKPGTEYIVDIWGVKG GLGSWPLSAIFTTGGHHHHHH |
| 1224 | PRT | Artificial | Luk047053 | MTIDEWLLKEAKEKAIEELKKAGITSDYYFD LINKAKTVEGVNALKDEILKAGGGGSGGGGS GGGGSGGGGSMLPAPKNLVVSRVTEDSARL SWTAPDAAFDSFNIHYAEYPDFGEAIVLTVPG SERSYDLTGLKPGTEYIVDIWGVKGGLGSWP LSAIFTTGGHHHHHH |
| 1225 | PRT | Artificial | Luk047054 | MLPAPKNLVVSRVTEDSARLSWTAPDAAFDS FAIEYEELRDWGEAIVLTVPGSERSYDLTGLK PGTEYSVSITGVKGGAESWPLSAIFTTGGGGS GGGGSGGGGSGGGGSMLPAPKNLVVSRVTE DSARLSWTAPDAAFDSFNIHYAEYPDFGEAI VLTVPGSERSYDLTGLKPGTEYIVDIWGVKG GLGSWPLSAIFTTGGHHHHHH |
| 1226 | PRT | Artificial | Luk047055 | MLPAPKNLVVSRVTEDSARLSWTAPDAAFDS FHIEYWEQSIVGEAIVLTVPGSERSYDLTGLK PGTEYRVWIYGVKGGNDSWPLSAIFTTGGGG SGGGGSGGGGSGGGGSMLPAPKNLVVSRVT EDSARLSWTAPDAAFDSFVIFYGEYENGGEAI VLTVPGSERSYDLTGLKPGTEYFVIIVGVKGG FDSKPLSAIFTTGGHHHHHH |
| 1227 | PRT | Artificial | Luk047056 | MTIDEWLLKEAKEKAIEELKKAGITSDYYFD LINKAKTVEGVNALKDEILKAGGGGSGGGGS GGGGSGGGGSMLPAPKNLVVSRVTEDSARL SWTAPDAAFDSFVIFYGEYENGGEAIVLTVP GSERSYDLTGLKPGTEYFVIIVGVKGGFDSKP LSAIFTTGGHHHHHH |
| 1228 | PRT | Artificial | Luk047057 | MLPAPKNLVVSRVTEDSARLSWTAPDAAFDS FAIEYEELRDWGEAIVLTVPGSERSYDLTGLK PGTEYSVSITGVKGGAESWPLSAIFTTGGGGS GGGGSGGGGSGGGGSMLPAPKNLVVSRVTE DSARLSWTAPDAAFDSFVIFYGEYENGGEAI VLTVPGSERSYDLTGLKPGTEYFVIIVGVKGG FDSKPLSAIFTTGGHHHHHH |
| 1229 | PRT | Artificial | Luk047058 | MLPAPKNLVVSRVTEDSARLSWTAPDAAFDS FHIEYWEQSIVGEAIVLTVPGSERSYDLTGLK PGTEYRVWIYGVKGGNDSWPLSAIFTTGGGG SGGGGSGGGGSGGGGSMLPAPKNLVVSRVT EDSARLSWTAPDAAFDSFQIFYQEVVEWGEA IVLTVPGSERSYDLTGLKPGTEYFVVIHGVKG GWISDPLSAIFTTGGHHHHHH |
| 1230 | PRT | Artificial | Luk047059 | MTIDEWLLKEAKEKAIEELKKAGITSDYYFD LINKAKTVEGVNALKDEILKAGGGGSGGGGS GGGGSGGGGSMLPAPKNLVVSRVTEDSARL |

TABLE 6-continued

Nucleic Acid and Amino Acid Sequences of the Disclosure

| SEQ ID NO: | Type | Species | Description | Sequence |
|---|---|---|---|---|
| | | | | SWTAPDAAFDSFQIFYQEVVEWGEAIVLTVP GSERSYDLTGLKPGTEYFVVIHGVKGGWISD PLSAIFTTGGHHHHHH |
| 1231 | PRT | Artificial | Luk047060 | MLPAPKNLVVSRVTEDSARLSWTAPDAAFDS FAIEYEELRDWGEAIVLTVPGSERSYDLTGLK PGTEYSVSITGVKGGAESWPLSAIFTTGGGGS GGGGSGGGGSGGGGSMLPAPKNLVVSRVTE DSARLSWTAPDAAFDSFQIFYQEVVEWGEAI VLTVPGSERSYDLTGLKPGTEYFVVIHGVKG GWISDPLSAIFTTGGHHHHHH |
| 1232 | PRT | Artificial | Luk047061 | MLPAPKNLVVSRVTEDSARLSWTAPDAAFDS FHIEYWEQSIVGEAIVLTVPGSERSYDLTGLK PGTEYRVWIYGVKGGNDSWPLSAIFTTGGGG SGGGGSGGGGSGGGGSMLPAPKNLVVSRVT EDSARLSWTAPDAAFDSFAIFYVELVWKGEA IVLTVPGSERSYDLTGLKPGTEYFVVIHGVKG GYISDPLSAIFTTGGHHHHHH |
| 1233 | PRT | Artificial | Luk047062 | MTIDEWLLKEAKEKAIEELKKAGITSDYYFD LINKAKTVEGVNALKDEILKAGGGGSGGGGS GGGGSGGGGSMLPAPKNLVVSRVTEDSARL SWTAPDAAFDSFAIFYVELVWKGEAIVLTVP GSERSYDLTGLKPGTEYFVVIHGVKGGYISDP LSAIFTTGGHHHHHH |
| 1234 | PRT | Artificial | Luk047063 | MLPAPKNLVVSRVTEDSARLSWTAPDAAFDS FAIEYEELRDWGEAIVLTVPGSERSYDLTGLK PGTEYSVSITGVKGGAESWPLSAIFTTGGGGS GGGGSGGGGSGGGGSMLPAPKNLVVSRVTE DSARLSWTAPDAAFDSFAIFYVELVWKGEAI VLTVPGSERSYDLTGLKPGTEYFVVIHGVKG GYISDPLSAIFTTGGHHHHHH |
| 1235 | PRT | Artificial | Luk047064 | MLPAPKNLVVSRVTEDSARLSWTAPDAAFDS FHIEYWEQSIVGEAIVLTVPGSERSYDLTGLK PGTEYRVWIYGVKGGNDSWPLSAIFTTGGGG SGGGGSGGGGSGGGGSMLPAPKNLVVSRVT EDSARLSWTAPDAAFDSFVIFYHETRVTGEAI VLTVPGSERSYDLTGLKPGTEYLVVIHGVKG GYISEPLSAIFTTGGHHHHHH |
| 1236 | PRT | Artificial | Luk047065 | MTIDEWLLKEAKEKAIEELKKAGITSDYYFD LINKAKTVEGVNALKDEILKAGGGGSGGGGS GGGGSGGGGSMLPAPKNLVVSRVTEDSARL SWTAPDAAFDSFVIFYHETRVTGEAIVLTVPG SERSYDLTGLKPGTEYLVVIHGVKGGYISEPL SAIFTTGGHHHHHH |
| 1237 | PRT | Artificial | Luk047066 | MLPAPKNLVVSRVTEDSARLSWTAPDAAFDS FAIEYEELRDWGEAIVLTVPGSERSYDLTGLK PGTEYSVSITGVKGGAESWPLSAIFTTGGGGS GGGGSGGGGSGGGGSMLPAPKNLVVSRVTE DSARLSWTAPDAAFDSFVIFYHETRVTGEAIV LTVPGSERSYDLTGLKPGTEYLVVIHGVKGG YISEPLSAIFTTGGHHHHHH |
| 1238 | PRT | Artificial | Luk047067 | MLPAPKNLVVSRVTEDSARLSWTAPDAAFDS FHIEYWEQSIVGEAIVLTVPGSERSYDLTGLK PGTEYRVWIYGVKGGNDSWPLSAIFTTGGGG SGGGGSGGGGSGGGGSMLPAPKNLVVSRVT EDSARLSWTAPDAAFDSFLIDYWEGEFDGEA IHLFVPGSERSYDLTGLKPGTEYDVFIVGVKG GHGSDPLSAIFTTGGHHHHHH |
| 1239 | PRT | Artificial | Luk047068 | MTIDEWLLKEAKEKAIEELKKAGITSDYYFD LINKAKTVEGVNALKDEILKAGGGGSGGGGS GGGGSGGGGSMLPAPKNLVVSRVTEDSARL SWTAPDAAFDSFLIDYWEGEFDGEAIHLFVP GSERSYDLTGLKPGTEYDVFIVGVKGGHGSD PLSAIFTTGGHHHHHH |
| 1240 | PRT | Artificial | Luk047069 | MLPAPKNLVVSRVTEDSARLSWTAPDAAFDS FAIEYEELRDWGEAIVLTVPGSERSYDLTGLK |

TABLE 6-continued

Nucleic Acid and Amino Acid Sequences of the Disclosure

| SEQ ID NO: | Type | Species | Description | Sequence |
|---|---|---|---|---|
| | | | | PGTEYSVSITGVKGGAESWPLSAIFTTGGGGS GGGGSGGGGSGGGGSMLPAPKNLVVSRVTE DSARLSWTAPDAAFDSFLIDYWEGEFDGEAI HLFVPGSERSYDLTGLKPGTEYDVFIVGVKG GHGSDPLSAIFTTGGHHHHHH |
| 1241 | PRT | Artificial | TENCON parent | LPAPKNLVVSRVTEDSARLSWTAPDAAFDSF LIQYQESEKVGEAIVLTVPGSERSYDLTGLKP GTEYTVSIYGVKGGHRSNPLSAIFTT |
| 1242 | PRT | Human | CR-5133 VH | EVQLVETGGGLVKPGGSLRLSCSASRFSFRD YYMTWIRQAPGKGPEWVSHISGSGSTIYYAD SVRGRFTISRDNAKSSLYLQMDSLQADDTAV YYCARGGRATSYYWVHWGPGTLVTVSS |
| 1243 | PRT | Human | CR-5133 VL | EIVLTQSPATLSLSPGERATLSCRASQSVSGYL GWYQQKPGQAPRLLIYGASSRATGIPDRFSG SGSGTDFTLTISRLEPEDFAVYYCQQYGSSPL TFGGGTKLEIK |

Although preferred embodiments have been depicted and described in detail herein, it will be apparent to those skilled in the relevant art that various modifications, additions, substitutions, and the like can be made without departing from the spirit of the disclosure and these are therefore considered to be within the scope of the disclosure as defined in the claims which follow.

SEQUENCE LISTING (1243 sequences)

SEQ ID NO: 1 - protein, 89 aa, Artificial
  Synthetic Tencon-25
LPAPKNLVVSEVTEDSARLSWTAPDAAFDSFLIQYQESEKVGEAIVLTVPGSERSYDLTGLKPGTEYTVSIYGVKGGHRSNPLSAIFTT

SEQ ID NO: 2 - protein, 20 aa, Artificial
  Synthetic Linker
GGGGSGGGGSGGGGSGGGGS

SEQ ID NO: 3 - protein, 6 aa, Artificial
  Synthetic Tencon  BC loop
TAPDAA

SEQ ID NO: 4 - protein, 7 aa, Artificial
  Synthetic Tencon FG loop
KGGHRSN

SEQ ID NO: 5 - DNA, 21 bp, Artificial
  Synthetic POP2222
cggcggttagaacgcggctac

SEQ ID NO: 6 - DNA, 30 bp, Artificial
  Synthetic POP2250
cggcggttagaacgcggctacaattaatac

SEQ ID NO: 7 - DNA, 22 bp, Artificial
  Synthetic DidLigRev
catgattacgccaagctcagaa

SEQ ID NO: 8 - DNA, 63 bp, Artificial
  Synthetic MDD40
agccgccgccaccggttaatggtgatggtgatggtgaccaccggtggtgaagatcgcagacag

SEQ ID NO: 9 - DNA, 58 bp, Artificial
  Synthetic MDD62
aagaaggagaaccggtatgctgccggcgccgaaaaacctggttgtttctcgtgttacc

SEQ ID NO: 10 - protein, 330 aa, S. aureus
HHHHHHNSAHKDSQDQNKKEHVDKSQQKDKRNVTNKDKNSTAPDDIGKNGKITKRTETVYDEKTNILQNLQFDFIDDPTYDKNVLLVKKQGSIHSNLKFESHKEEKNSNWLKYPSEYHVDFQVKRNRKTEILDQLPKNKISTAKVDSTFSYSSGGKFDSTKGIGRTSSNSYSKTISYNQQNYDTIASGKNNNWHVHWSVIANDLKYGGEVKNRNDELLFYRNTRIATVENPELSFASKYRYPALVRSGFNPEFLTYLSNEKSNEKTQFEVTYTRNQDILKNRPGIHYAPPILEKNKDGQRLIVTYEVDWKNKTVKVVDKYSDDNKPYKAG

SEQ ID NO: 11 - protein, 309 aa, S. aureus
KINSEIKQVSEKNLDGDTKMYTRTATTSDSQKNITQSLQFNFLTEPNYDKETVFIKAKGTIGSGLRILDPNGYWNSTLRWPGSYSVSIQNVDDNNNTNVTDFAPKNQDESREVKYTYGYKTGGDFSINRGGLTGNITKESNYSETISYQQPSYRTLLDQSTSHKGVGWKVEAHLINNMGHDHTRQLTNDSDNRTKSEIFSLTRNGNLWAKDNFTPKDKMPVTVSEGFNPEFLAVMSHDKKDKGKSQFVVHYKRSMDEFKIDWNRHGFWGYWSGENHVDKKEEKLSALYEVDWKTHNVKFVKVLNDNEKK

SEQ ID NO: 12 - protein, 323 aa, S. aureus
MGSSHHHHHHSSGLVPAGSHMLAQHITPVSEKKVDDKITLYKTTATSDNDKLNISQILTFNFIKDKSYDKDTLVLKAAGNINSGYKKPNPKDYNYSQFYWGGKYNVSVSSESNDAVNVVDYAPKNQNEEFQVQQTLGYSYGGDINISNGLSGGLNGSKSFSETINYKQESYRTTIDRKTNHKSIGWGVEAHKIMNNGWGPYGRDSYDPTYGNELFLGGRQSSSNAGQNFLPTHQMPLLARGNFNPEFISVLSHKQNDTKKSKIKVTYQREMDRYTNQWNRLHWVGNNYKNQNTVTFTSTYEVDWQNHTVKLIGTDSKETNPGV

SEQ ID NO: 13 - protein, 305 aa, S. aureus
MGSSHHHHHHSSGLVPAGSHMLNTNIENIGDGAEVIKRTEDVSSKKWGVTQNVQFDFVKDKKYNKDALIVKMQGFINSRTSFSDVKGSGYELTKRMIWPFQYNIGLTTKDPNVSLINYLPKNKIETTDVGQTLGYNIGGNFQSAPSIGGNGSFNYSKTISYTQKSYVSEVDKQNSKSVKWGVKANEFVTPDGKKSAHDRYLFVQSPNGPTGSAREYFAPDNQLPPLVQSGFNPSFITTLSHEKGSSDTSEFEISYGRNLDITYATLFPRTGIYAERKHNAFVNRNFVVRYEVNWKTHEIKVKGHN

SEQ ID NO: 14 - protein, 89 aa, Artificial
  Synthetic Luk17 LukAB binding FN3 domain
LPAPKNLVVSRVTEDSARLSWTAPDAAFDSFWITYEEKFYRGEAIVLTVPGSERSYDLTGLKPGTEYKVWIVGVKGGQGSWPLSAIFTT

SEQ ID NO: 15 - protein, 94 aa, Artificial
  Synthetic Luk19 LukAB binding FN3 domain
LPAPKNLVVSRVTEDSARLSWYHAIHRLNHFDSFLIQYQESEKVGEAIVLTVPGSERSYDLAGLKPGTEYTVSIYGVLPDAFVSSNPLSAIFTT

SEQ ID NO: 16 - protein, 94 aa, Artificial
  Synthetic Luk20 LukAB binding FN3 domain
LPAPKNLVVSRVTEDSARLSWYHAIHRLNHFDSFLIQYQESEKVGEAIVLTVPGSERSYDLTGLKPGTEYTVSIYGVLPDAFVSSNPLSAIFTT

SEQ ID NO: 17 - protein, 89 aa, Artificial
  Synthetic Luk24 LukAB binding FN3 domain
LPAPKNLVVSRVTEDSARLSWTAPDAAFDSFQIGYFELWPNGEAIVLTVPGSERSYDLTGLKPGTEYEVFIRGVKGGLYSYPLSAIFTT

SEQ ID NO: 18 - protein, 97 aa, Artificial
  Synthetic Luk8 LukD binding FN3 domain
LPAPKNLVVSRVTEDSARLSWKRKPWAPIFDSFLIQYQESEKVGEAIVLTVPGSERSYDLTGLKPGTEYTVSIYGVWDHAGPKYEIESNPLSAIFTT

SEQ ID NO: 19 - protein, 95 aa, Artificial
  Synthetic Luk9 LukD binding FN3 domain
LPAPKNLVVSRVTEDSARLSWDRTYSLLNYFDSFLIQYQESEKVGEAIVLTVPGSERSYDLTGLKPGTEYTVSIYGVGGQHPTYESNPLSAIFTT

SEQ ID NO: 20 - protein, 97 aa, Artificial
  Synthetic Luk10 LukD binding FN3 domain
LPAPKNLVVSRVTEDSARLSWAASENAFVFDSFLIQYQESEKVGEAIVLTVPGSERSYDLTGLKPGTEYTVSIYGVGGKLHNQFEWLSNPLSAIFTT

SEQ ID NO: 21 - protein, 94 aa, Artificial
  Synthetic Luk11 LukD binding FN3 domain
LPAPKNLVVSRVTEDSARLSWRAKPWAPKFDSFLIQYQESEKVGEAIVLTVPGSERSYDLTGLKPGTEYTVSIYGVSAIKPGHTSNPLSAIFTT

SEQ ID NO: 22 - protein, 94 aa, Artificial
  Synthetic Luk12 LukD binding FN3 domain
LPAPKNLVVSRVTEDSARLSWRAKPWAPKFDSFLIQYQESEKVGEAIVLTVPGSERSYDLTGLKPGTEYTVSIYGVKASEKFIESNPLSAIFTT

SEQ ID NO: 23 - protein, 97 aa, Artificial
  Synthetic Luk21 LukD binding FN3 domain
LPAPKNLVVSRVTEDSARLSWVTKPWAEYFDSFLIQYQESEKVGEAIVLTVPGSERSYDLTGLKPGTEYTVSIYGVWDHAGPKYEIESNPLSAIFTT

SEQ ID NO: 24 - protein, 94 aa, Artificial
  Synthetic Luk22 LukD binding FN3 domain
LPAPKNLVVSRVTEDSARLSWRAKPWAPKFDSFLIQYQESEKVGEAIVLTVPGSERSYDLTGLKPGTEYAVSIYGVKASEKFIESNPLSAIFTT

SEQ ID NO: 25 - protein, 89 aa, Artificial
  Synthetic Luk26 LukE binding FN3 domain
LPAPKNLVVSRVTEDSARLSWTAPDAAFDSFHIEYAEPWVWGEAIVLTVPGSERSYDLTGLKPGTEYVVFIGGVKGGHNSTPLSAIFTT

SEQ ID NO: 26 - protein, 89 aa, Artificial
  Synthetic Luk27 LukE binding FN3 domain
LPAPKNLVVSRVTEDSARLSWTAPDAAFDSFPIVYQEWQFYGEAIVLTVPGSERSYDLTGLKPGTEYLVDIYGVKGGSWSYPLSAIFTT

SEQ ID NO: 27 - protein, 89 aa, Artificial
  Synthetic Luk28 LukE binding FN3 domain
LPAPKNLVVSRVTEDSARLSWTAPDAAFDSFAIQYWEWWPPGEAIVLTVPGSERSYDLTGLKPGTEYGVIILGVKGGWYSNPLSAIFTT

SEQ ID NO: 28 - protein, 97 aa, Artificial
  Synthetic Luk29 LukE binding FN3 domain
LPAPKNLVVSRVTEDSARLSWDEQFVSNFDSFLIQYQESEKVGEAIVLTVPGSERSYDLTGLKPGTEYTVSIYGVFVPWDGFSEINYSNPLSAIFTT

SEQ ID NO: 29 - protein, 95 aa, Artificial
  Synthetic Luk30 LukE binding FN3 domain
LPAPKNLVVSRVTEDSARLSWAFNWNYFAFDSFLIQYQESEKVGEAIVLTVPGSERSYDLTGLKPGTEYTVSIYGVVALNTGNKKSNPLSAIFTT

SEQ ID NO: 30 - protein, 99 aa, Artificial
  Synthetic Luk31 LukE binding FN3 domain
LPAPNNLVVSRVTEDSARLSWDWDKYYTNRFDSFLIQYQESEKVGEAIVLTVPGSERSYDLTGLKPGTEYTVSIYGVLVRDYIRAAEWYSNPLSAIFTT

SEQ ID NO: 31 - protein, 96 aa, Artificial
  Synthetic Luk32 LukE binding FN3 domain
LPAPKNLVVSRVTEDSARLSWYHENAYLLFDSFLIQYQESEKVGEAIVLTVPGSERSYDLTGLKPGTEYTVSIYGVVYDLTPEKRSSNPLSAIFTT

SEQ ID NO: 32 - protein, 93 aa, Artificial
  Synthetic Luk33 LukE binding FN3 domain
LPAPKNLVVSRVTEDSARLSWTAPDAAFDSFLIQYQESEKVGEAIVLTVPGSERSYDLTGLKPGTEYTVSIYGVAFIPDEIEFSNPLSAIFTT

SEQ ID NO: 33 - protein, 93 aa, Artificial
  Synthetic Luk34 LukE binding FN3 domain
LPAPKNLVVSRVTEDSARLSWTAPDAAFDSFLIQYQESEKVGEAIVLTVPGSERSYDLTGPKPGTEYTVSIYGVVVVPHEFEFSNPLSAIFTT

SEQ ID NO: 34 - protein, 93 aa, Artificial
  Synthetic Luk35 LukE binding FN3 domain
LPAPKNLVVSRVTEDSARLSWTAPDAAFDSFLIQYQESEKVGEAIVLTVPGSERSYDLTGLKPGTEYTVSIYGVAHIPWEFEWSKPLSAIFTT

SEQ ID NO: 35 - protein, 93 aa, Artificial
  Synthetic Luk36 LukE binding FN3 domain
LPAPKNLVVSRVTEDSARLSWTAPDAAFDSFLIQYQESEKVGEAIVLTVPGSERSYDLTGLKPGTEYTVSIYGVADVPDEYEFSNPLSAIFTT

SEQ ID NO: 36 - protein, 92 aa, Artificial
  Synthetic Luk37 LukE binding FN3 domain
LPAPKNLVVSRVTEDSARLSWTAPDAAFDSFLIQYQESEKVGEAIVLTVPGSERSYDLTGLKPGTEYTVSIYGVVGWPLFIQSNPLSAIFTT

SEQ ID NO: 37 - protein, 96 aa, Artificial
  Synthetic Luk38 LukE binding FN3 domain
LPAPKNLVVSRVTEDSARLSWTAPDAAFDSFLIQYQESEKVGEAIVLTVPGSERSYDLTGLKPGTEYTVSIYGVELIYHGWLDFVFSNPLSAIFTT

SEQ ID NO: 38 - protein, 96 aa, Artificial
  Synthetic Luk39 LukE binding FN3 domain
LPAPKNLVVSRVTEDSARLSWTAPDAAFDSFLIQYQESEKVGEAIVLTVPGSERSYDLTGLKPGTEYTVSIYGVRVFYFSVEPTWFSNPLSAIFTT

SEQ ID NO: 39 - protein, 95 aa, Artificial
  Synthetic Luk40 LukE binding FN3 domain
LPAPKNLVVSRVTEDSARLSWTAPDAAFDSFLIQYQESEKVGEAIVLTVPGSERSYDLTGLKPGTEYTVSIYGVSYAGEPLLWIYSNPLSAIFTT

SEQ ID NO: 40 - protein, 94 aa, Artificial
  Synthetic Luk41 LukE binding FN3 domain
LPAPKNLVVSRVTEDSARLSWTAPDAAFDSFLIQYQESEKVGEAIVLTVPGSERSYDLTGLKPGTEYTVSIYGVSEVPYSEYWFSNPLSAIFTT

SEQ ID NO: 41 - protein, 94 aa, Artificial
  Synthetic Luk42 LukE binding FN3 domain
LPAPKNLVVSRVTEDSARLSWTAPDAAFDSFLIQYQESEKVGEAIVLTVPGSERSYDLTGLKPGTEYTVSIYGVVWGYRLTTEHSNPLSAIFTT

SEQ ID NO: 42 - protein, 95 aa, Artificial
  Synthetic Luk43 LukE binding FN3 domain
LPAPKNLVVSRVTEDSARLSWTAPDAAFDSFLIQYQESEKVGEAIVLTVPGSERSYDLTGLKPGTEYTVSIYGVNSFGRPTLNLFSNPLSAIFTT

SEQ ID NO: 43 - protein, 95 aa, Artificial
  Synthetic Luk44 LukE binding FN3 domain
LPAPKNLVVSRVTEDSARLSWTAPDAAFDSFLIQYQESEKVGEAIVLTVPGSERSYDLTGLKPGTEYTVSIYGVEWLQYYGETLFSNPLSAIFTT

SEQ ID NO: 44 - protein, 95 aa, Artificial
  Synthetic Luk45 LukE binding FN3 domain
LPAPKNLVVSRVTEDSARLSWTAPDAAFDSFLIQYQESEKVGEAIVLTVPGSERSYDLTGLKPGTEYTVSIYGVAWLTNAYEWEFSNPLSAIFTT

SEQ ID NO: 45 - protein, 89 aa, Artificial
  Synthetic Luk46 LukE binding FN3 domain
LPAPKNLVVSRVTEDSARLSWTAPDAAFDSFWIHYEESTWAGEAIVLTVPGSERSYDLTGLKPGTEYGVVIVGVKGGLKSHPLSAIFTT

SEQ ID NO: 46 - protein, 89 aa, Artificial
  Synthetic Luk47 LukE binding FN3 domain
LPAPKNLVVSRVTEDSARLSWTAPDAAFDSFGIQYFETTESGEAIVLTVPGSERSYDLTGLKPGTEYVVFISGVKGGPLSWPLSAIFTT

SEQ ID NO: 47 - protein, 89 aa, Artificial
  Synthetic Luk48 LukE binding FN3 domain
LPAPKNLVVSRVTEDSARLSWTAPDAAFDSFHIEYGEWWPTGEAIVLTVPGSERSYDLTGLKPGTEYGVLIVGVKGGFRSSPLSAIFTT

SEQ ID NO: 48 - protein, 89 aa, Artificial
  Synthetic Luk49 LukE binding FN3 domain
LPAPKNLVVSRVTEDSARLSWTAPDAAFDSFAIVYAEHWPAGEAIVLTVPGSERSYDLTGLKPGTEYNVTIPGVKGGKYSDPLSAIFTT

SEQ ID NO: 49 - protein, 89 aa, Artificial
  Synthetic Luk50 LukE binding FN3 domain
LPAPKNLVVSRVTEDSARLSWTAPDAAFDSFVIPYSEWWPVGEAIVLTVPGSERSYDLTGLKPGTEYGVYIVGVKGGTWSAPLSAIFTT

SEQ ID NO: 50 - protein, 89 aa, Artificial
  Synthetic Luk51 LukE binding FN3 domain
LPAPKNLVVSRVTEDSARLSWTAPDAAFDSFQIHYFESEPGGEAIVLTVPGSERSYDLTGLKPGTEYVVFIIGVKGGWSSLPLSAIFTT

SEQ ID NO: 51 - protein, 89 aa, Artificial
  Synthetic Luk52 LukE binding FN3 domain
LPAPKNLVVSRVTEDSARLSWTAPDAAFDSFWIQYGEAQEFGEAIVLTVPGSERSYDLTGLKPGTEYIVFITGVKGGNKSYPLSAIFTT

SEQ ID NO: 52 - protein, 89 aa, Artificial
  Synthetic Luk53 LukE binding FN3 domain
LPAPKNLVVSRVTEDSARLSWTAPDAAFDSFTIQYFEAEANGEAIVLTVPGSERSYDLTGLKPGTEYLVFIVGVKGGHSSLPLSAIFTT

SEQ ID NO: 53 - protein, 89 aa, Artificial
  Synthetic Luk54 LukE binding FN3 domain
LPAPKNLVVSRVTEDSARLSWTAPDAVFDSFRIEYSEWWPIGEAIVLTVPGSERSYDLTGLKPGTEYGVVIAGVKGGGYSVPLSAIFTT

SEQ ID NO: 54 - protein, 89 aa, Artificial
  Synthetic Luk55 LukE binding FN3 domain
LPAPKNLVVSRVTEDSARLSWTAPDAAFDSFWIQYFESAGEGEAIVLTVPGSERSYDLTGLKPGTEYLVFIVGVKGGVPSYPLSAIFTT

SEQ ID NO: 55 - protein, 88 aa, Artificial
  Synthetic Luk56 LukE binding FN3 domain
LPAPKNLVVSRVTEDSARLSWTAPDAAFDSFYIQYIELEIGEAIVLTVPGSERSYDLTGLKPGTEYGVFISGVKGGWNSYPLSAIFTT

SEQ ID NO: 56 - protein, 89 aa, Artificial
  Synthetic Luk57 LukE binding FN3 domain
LPAPKNLVVSRVTEDSARLSWTAPDAAFNSFYIEYFEWFPAGEAIVLTVPGSERSYDLTGLKPGTEYAVIIHGVKGGQRSTPLSAIFTT

SEQ ID NO: 57 - protein, 89 aa, Artificial
  Synthetic Luk58 LukE binding FN3 domain
LPAPKNLVVSRVTEDSARLSWTAPDAAFDSFDIEYDESAHFGEAIVLTVPGSERSYDLTGLKPGTEYIVFIYGVKGGYASIPLSAIFTT

SEQ ID NO: 58 - protein, 89 aa, Artificial
  Synthetic Luk59 LukE binding FN3 domain
LPAPKNLVVSRVTEDSARLSWTAPDAAFDSFDISYNEFAWSGEAIVLTVPGSERSYDLTGLKPGTEYVVYIHGVKGGPTSYPLSAIFTT

SEQ ID NO: 59 - protein, 89 aa, Artificial
  Synthetic Luk60 LukE binding FN3 domain
LPAPKNLVVSRVTEDSARLSWTAPDAAFDSFDIQYWEWWPFGEAIVLTVPGSERSYDLTGLKPGTEYGVIILGVKGGFRSTPLSAIFTT

SEQ ID NO: 60 - protein, 450 aa, Homo sapiens
EVQLVETGGGLVKPGGSLRLSCSASRFSFRDYYMTWIRQAPGKGPEWVSHISGSGSTIYYADSVRGRFTISRDNAKSSLYLQMDSLQADDTAVYYCARGGRATSYYWVHWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 61 - protein, 214 aa, Homo sapiens
EIVLTQSPATLSLSPGERATLSCRASQSVSGYLGWYQQKPGQAPRLLIYGASSRATGIPDRFSGSGSGTDFTLTISRLEPEDFAVYYCQQYGSSPLTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 62 - protein, 449 aa, Homo sapiens
EVQLVETGGGLVKPGGSLRLSCSASRFSFRDYYMTWIRQAPGKGPEWVSHISGSGSTIYYADSVRGRFTISRDNAKSSLYLQMDSLQADDTAVYYCARGGRATSYYWVHWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPDVFLFPPKPKDTLMISRTPEVTCVVVDVSHEDPEVKFNWYVDGVEVHNAKTKPREEQYNSTYRVVSVLTVLHQDWLNGKEYKCKVSNAALPAPIAKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 63 - protein, 214 aa, Homo sapiens; identical to SEQ ID NO: 61

SEQ ID NO: 64 - protein, 450 aa, Homo sapiens
EVQLVETGGGLVKPGGSLRLSCSASRFSFRDYYMTWIRQAPGKGPEWVSHISGSGSTIYYADSVRGRFTISRDNAKSSLYLQMDSLQADDTAVYYCARGGRATSYYWVHWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNRFTQKSLSLSPGK

SEQ ID NO: 65 - protein, 214 aa, Homo sapiens; identical to SEQ ID NO: 61

SEQ ID NO: 66 - protein, 449 aa, Homo sapiens
EVQLVETGGGLVKPGGSLRLSCSASRFSFRDYYMTWIRQAPGKGPEWVSHISGSGSTIYYADSVRGRFTISRDNAKSSLYLQMDSLQADDTAVYYCARGGRATSYYWVHWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPDVFLFPPKPKDTLMISRTPEVTCVVVDVSHEDPEVKFNWYVDGVEVHNAKTKPREEQYNSTYRVVSVLTVLHQDWLNGKEYKCKVSNAALPAPIAKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNRFTQKSLSLSPGK

SEQ ID NO: 67 - protein, 214 aa, Homo sapiens; identical to SEQ ID NO: 61

SEQ ID NO: 68 - protein, 449 aa, Artificial; identical to SEQ ID NO: 66
  Synthetic CR5133 PRASA A6 LC-D Heavy Chain

SEQ ID NO: 69 - protein, 328 aa, Artificial
  Synthetic CR5133 PRASA A6 LC-D Light Chain
EIVLTQSPATLSLSPGERATLSCRASQSVSGYLGWYQQKPGQAPRLLIYGASSRATGIPDRFSGSGSGTDFTLTISRLEPEDFAVYYCQQYGSSPLTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECGGGGSGGGGSGGGGSGGGGSLPAPKNLVVSRVTEDSARLSWRAKPWAPKFDSFLIQYQESEKVGEAIVLTVPGSERSYDLTGLKPGTEYTVSIYGVKASEKFIESNPLSAIFTT

SEQ ID NO: 70 - protein, 559 aa, Artificial
  Synthetic CR5133 PRASA A6 HC-AB Heavy Chain
EVQLVETGGGLVKPGGSLRLSCSASRFSFRDYYMTWIRQAPGKGPEWVSHISGSGSTIYYADSVRGRFTISRDNAKSSLYLQMDSLQADDTAVYYCARGGRATSYYWVHWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPDVFLFPPKPKDTLMISRTPEVTCVVVDVSHEDPEVKFNWYVDGVEVHNAKTKPREEQYNSTYRVVSVLTVLHQDWLNGKEYKCKVSNAALPAPIAKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNRFTQKSLSLSPGKGGGGSGGGGSGGGGSGGGGSMLPAPKNLVVSRVTEDSARLSWTAPDAAFDSFWITYEEKFYRGEAIVLTVPGSERSYDLTGLKPGTEYKVWIVGVKGGQGSWPLSAIFTT

SEQ ID NO: 71 - protein, 214 aa, Artificial; identical to SEQ ID NO: 61
  Synthetic CR5133 PRASA A6 HC-AB Light Chain

SEQ ID NO: 72 - protein, 559 aa, Artificial; identical to SEQ ID NO: 70
  Synthetic CR5133 PRASA A6 LC-D HC-AB Heavy Chain

SEQ ID NO: 73 - protein, 328 aa, Artificial; identical to SEQ ID NO: 69
  Synthetic CR5133 PRASA A6 LC-D HC-AB Light Chain

SEQ ID NO: 74 - protein, 563 aa, Artificial
  Synthetic CR5133 PRASA A6 HC-D Heavy Chain
EVQLVETGGGLVKPGGSLRLSCSASRFSFRDYYMTWIRQAPGKGPEWVSHISGSGSTIYYADSVRGRFTISRDNAKSSLYLQMDSLQADDTAVYYCARGGRATSYYWVHWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPDVFLFPPKPKDTLMISRTPEVTCVVVDVSHEDPEVKFNWYVDGVEVHNAKTKPREEQYNSTYRVVSVLTVLHQDWLNGKEYKCKVSNAALPAPIAKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNRFTQKSLSLSPGKGGGGSGGGGSGGGGSGGGGSLPAPKNLVVSRVTEDSARLSWRAKPWAPKFDSFLIQYQESEKVGEAIVLTVPGSERSYDLTGLKPGTEYTVSIYGVKASEKFIESNPLSAIFTT

SEQ ID NO: 75 - protein, 214 aa, Artificial; identical to SEQ ID NO: 61
  Synthetic CR5133 PRASA A6 HC-D Light Chain

SEQ ID NO: 76 - protein, 673 aa, Artificial
  Synthetic CR5133 PRASA A6 HC AB-D Heavy Chain
EVQLVETGGGLVKPGGSLRLSCSASRFSFRDYYMTWIRQAPGKGPEWVSHISGSGSTIYYADSVRGRFTISRDNAKSSLYLQMDSLQADDTAVYYCARGGRATSYYWVHWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPDVFLFPPKPKDTLMISRTPEVTCVVVDVSHEDPEVKFNWYVDGVEVHNAKTKPREEQYNSTYRVVSVLTVLHQDWLNGKEYKCKVSNAALPAPIAKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNRFTQKSLSLSPGKGGGGSGGGGSGGGGSGGGGSMLPAPKNLVVSRVTEDSARLSWTAPDAAFDSFWITYEEKFYRGEAIVLTVPGSERSYDLTGLKPGTEYKVWIVGVKGGQGSWPLSAIFTTGGGGSGGGGSGGGGSGGGGSLPAPKNLVVSRVTEDSARLSWRAKPWAPKFDSFLIQYQESEKVGEAIVLTVPGSERSYDLTGLKPGTEYTVSIYGVKASEKFIESNPLSAIFTT

SEQ ID NO: 77 - protein, 214 aa, Artificial; identical to SEQ ID NO: 61
  Synthetic CR5133 PRASA A6 HC AB-D Light Chain

SEQ ID NO: 78 - protein, 673 aa, Artificial
  Synthetic CR5133 PRASA A6 HC D-AB Heavy Chain
EVQLVETGGGLVKPGGSLRLSCSASRFSFRDYYMTWIRQAPGKGPEWVSHISGSGSTIYYADSVRGRFTISRDNAKSSLYLQMDSLQADDTAVYYCARGGRATSYYWVHWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPDVFLFPPKPKDTLMISRTPEVTCVVVDVSHEDPEVKFNWYVDGVEVHNAKTKPREEQYNSTYRVVSVLTVLHQDWLNGKEYKCKVSNAALPAPIAKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNRFTQKSLSLSPGKGGGGSGGGGSGGGGSGGGGSLPAPKNLVVSRVTEDSARLSWRAKPWAPKFDSFLIQYQESEKVGEAIVLTVPGSERSYDLTGLKPGTEYTVSIYGVKASEKFIESNPLSAIFTTGGGGSGGGGSGGGGSGGGGSMLPAPKNLVVSRVTEDSARLSWTAPDAAFDSFWITYEEKFYRGEAIVLTVPGSERSYDLTGLKPGTEYKVWIVGVKGGQGSWPLSAIFTT

SEQ ID NO: 79 - protein, 214 aa, Artificial; identical to SEQ ID NO: 61
  Synthetic CR5133 PRASA A6 HC D-AB Light Chain

SEQ ID NO: 80 - DNA, 376 bp, Artificial
  Synthetic BC6
  misc_feature (198)..(215): n is a, c, g, or t
gtgacacggcggttagaacgcggctacaattaatacataaccccatccccctgttgacaattaatcatcggctcgtataatgtgtggaattgtgagcggataacaatttcacacaggaaacaggatctaccatgctgccggcgccgaaaaacctggttgtttctgaagttaccgaagactctctgcgtctgtcttggnnnnnnnnnnnnnnnnnnttygactctttcctgatccagtaccaggaatctgaaaaagttggtgaagcgatcaacctgaccgttccgggttctgaacgttcttacgacctgaccggtctgaaaccgggtaccgaatacaccgtttctatctacggtgttcttagaagcttcccaaaggc

SEQ ID NO: 81 - DNA, 379 bp, Artificial
  Synthetic BC7
  misc_feature (198)..(218): n is a, c, g, or t
gtgacacggcggttagaacgcggctacaattaatacataaccccatccccctgttgacaattaatcatcggctcgtataatgtgtggaattgtgagcggataacaatttcacacaggaaacaggatctaccatgctgccggcgccgaaaaacctggttgtttctgaagttaccgaagactctctgcgtctgtcttggnnnnnnnnnnnnnnnnnnnnnttygactctttcctgatccagtaccaggaatctgaaaaagttggtgaagcgatcaacctgaccgttccgggttctgaacgttcttacgacctgaccggtctgaaaccgggtaccgaatacaccgtttctatctacggtgttcttagaagcttcccaaaggc

SEQ ID NO: 82 - DNA, 382 bp, Artificial
  Synthetic BC8
  misc_feature (198)..(221): n is a, c, g, or t
gtgacacggcggttagaacgcggctacaattaatacataaccccatccccctgttgacaattaatcatcggctcgtataatgtgtggaattgtgagcggataacaatttcacacaggaaacaggatctaccatgctgccggcgccgaaaaacctggttgtttctgaagttaccgaagactctctgcgtctgtcttggnnnnnnnnnnnnnnnnnnnnnnnnttygactctttcctgatccagtaccaggaatctgaaaaagttggtgaagcgatcaacctgaccgttccgggttctgaacgttcttacgacctgaccggtctgaaaccgggtaccgaatacaccgtttctatctacggtgttcttagaagcttcccaaaggc

SEQ ID NO: 83 - DNA, 385 bp, Artificial
  Synthetic BC9
  misc_feature (198)..(224): n is a, c, g, or t
gtgacacggcggttagaacgcggctacaattaatacataaccccatccccctgttgacaattaatcatcggctcgtataatgtgtggaattgtgagcggataacaatttcacacaggaaacaggatctaccatgctgccggcgccgaaaaacctggttgtttctgaagttaccgaagactctctgcgtctgtcttggnnnnnnnnnnnnnnnnnnnnnnnnnnnttygactctttcctgatccagtaccaggaatctgaaaaagttggtgaagcgatcaacctgaccgttccgggttctgaacgttcttacgacctgaccggtctgaaaccgggtaccgaatacaccgtttctatctacggtgttcttagaagcttcccaaaggc

SEQ ID NO: 84 - DNA, 131 bp, Artificial
  Synthetic 130mer-L17A
cggcggttagaacgcggctacaattaatacataaccccatccccctgttgacaattaatcatcggctcgtataatgtgtggaattgtgagcggataacaatttcacacaggaaacaggatctaccatgctg

SEQ ID NO: 85 - DNA, 30 bp, Artificial; identical to SEQ ID NO: 6
  Synthetic POP2222ext

SEQ ID NO: 86 - DNA, 81 bp, Artificial
  Synthetic LS1114
ccaagacagacgggcagagtcttcggtaacgcgagaaacaaccaggtttttcggcgccggcagcatggtagatcctgtttc

SEQ ID NO: 87 - DNA, 26 bp, Artificial
  Synthetic LS1115
ccgaagactctgcccgtctgtcttgg

SEQ ID NO: 88 - DNA, 45 bp, Artificial
  Synthetic LS1117
cagtggtctcacggattcctggtactggatcaggaaagagtcgaa

SEQ ID NO: 89 - DNA, 54 bp, Artificial
  Synthetic SDG10
catgcggtctcttccgaaaaagttggtgaagcgatcgtcctgaccgttccgggt

SEQ ID NO: 90 - DNA, 29 bp, Artificial
  Synthetic SDG24
ggtggtgaagatcgcagacagcgggttag

SEQ ID NO: 91 - DNA, 61 bp, Artificial
  Synthetic SDG28
aagatcagttgcggccgctagactagaaccgctgccaccgccggtggtgaagatcgcagac

SEQ ID NO: 92 - protein, 89 aa, Artificial
  Synthetic TCL19
  MISC_FEATURE (32)..(32): Xaa at position 32 is any amino acid except cysteine or methionine
  MISC_FEATURE (34)..(34): Xaa at position 34 is any amino acid except cysteine or methionine
  MISC_FEATURE (36)..(36): Xaa at position 36 is any amino acid except cysteine or methionine
  MISC_FEATURE (38)..(41): Xaa at positions 38-41 is any amino acid except cysteine or methionine
  MISC_FEATURE (68)..(68): Xaa at position 68 is any amino acid except cysteine or methionine
  MISC_FEATURE (70)..(70): Xaa at position 70 is any amino acid except cysteine or methionine
  MISC_FEATURE (72)..(72): Xaa at position 72 is any amino acid except cysteine or methionine
  MISC_FEATURE (78)..(79): Xaa at positions 78-79 is any amino acid except cysteine or methionine
  MISC_FEATURE (81)..(81): Xaa at position 81 is any amino acid except cysteine or methionine
LPAPKNLVVSRVTEDSARLSWTAPDAAFDSFXIXYXEXXXXGEAIVLTVPGSERSYDLTGLKPGTEYXVXIXGVKGGXXSXPLSAIFTT

SEQ ID NO: 93 - protein, 9 aa, Artificial
  Synthetic TCL19 C strand
  MISC_FEATURE (4)..(4): Xaa at position 4 is any amino acid except cysteine or methionine
  MISC_FEATURE (6)..(6): Xaa at position 6 is any amino acid except cysteine or methionine
  MISC_FEATURE (8)..(8): Xaa at position 8 is any amino acid except cysteine or methionine
DSFXIXYXE

SEQ ID NO: 94 - protein, 10 aa, Artificial
  Synthetic TCL19 F strand
  MISC_FEATURE (4)..(4): Xaa at position 4 is any amino acid except cysteine or methionine
  MISC_FEATURE (6)..(6): Xaa at position 6 is any amino acid except cysteine or methionine
  MISC_FEATURE (8)..(8): Xaa at position 8 is any amino acid except cysteine or methionine
TEYXVXIXGV

SEQ ID NO: 95 - protein, 15 aa, Artificial
  Synthetic TCL19 C strand + CD loop
  MISC_FEATURE (4)..(4): Xaa at position 4 is any amino acid except cysteine or methionine
  MISC_FEATURE (6)..(6): Xaa at position 6 is any amino acid except cysteine or methionine
  MISC_FEATURE (8)..(8): Xaa at position 8 is any amino acid except cysteine or methionine
  MISC_FEATURE (10)..(13): Xaa at positions 10-13 is any amino acid except cysteine or methionine
DSFXIXYXEXXXXGE

SEQ ID NO: 96 - protein, 17 aa, Artificial
  Synthetic TCL19 F strand + FG loop
  MISC_FEATURE (4)..(4): Xaa at position 4 is any amino acid except cysteine or methionine
  MISC_FEATURE (6)..(6): Xaa at position 6 is any amino acid except cysteine or methionine
  MISC_FEATURE (8)..(8): Xaa at position 8 is any amino acid except cysteine or methionine
  MISC_FEATURE (14)..(15): Xaa at positions 14-15 is any amino acid except cysteine or methionine
  MISC_FEATURE (17)..(17): Xaa at position 17 is any amino acid except cysteine or methionine
TEYXVXIXGVKGGXXSX

SEQ ID NO: 97 - protein, 28 aa, Artificial
  Synthetic TCL19 A strand + AB loop + B strand + BC loop
  MISC_FEATURE (6)..(6): Xaa at position 6 is any amino acid except cysteine or methionine
  MISC_FEATURE (8)..(8): Xaa at position 8 is any amino acid except cysteine or methionine
  MISC_FEATURE (10)..(11): Xaa at positions 10-11 is any amino acid except cysteine or methionine
  MISC_FEATURE (13)..(16): Xaa at positions 13-16 is any amino acid except cysteine or methionine
  MISC_FEATURE (18)..(18): Xaa at position 18 is any amino acid except cysteine or methionine
  MISC_FEATURE (20)..(20): Xaa at position 20 is any amino acid except cysteine or methionine
  MISC_FEATURE (22)..(22): Xaa at position 22 is any amino acid except cysteine or methionine
LPAPKXLXVXXVXXXXAXLXWXAPDAAF

SEQ ID NO: 98 - protein, 5 aa, Artificial
  Synthetic TCL19 E strand
  MISC_FEATURE (1)..(1): Xaa at position 1 is any amino acid except cysteine or methionine
  MISC_FEATURE (3)..(3): Xaa at position 3 is any amino acid except cysteine or methionine
XYXLT

SEQ ID NO: 99 - protein, 533 aa, S. aureus
MKETAAAKFERQHMDSPDLGTLVPRGSMAMNYFVGNSLGVNLTGIEKAIINRLNLFKEMGRPAQCVFLSWNRYLYRNAQNYITSSDYINMYDFFQEATYLERNEPFDWLSYWTDECHYTLKHVENSHDFRIYDQERFLMYAHFQDPKYRILDYVNHFDSQRRKVKRDFYDVRGFLSCSRILVDKQQTLCEFFYNPEDDTKLEKYFSYKDGKPEVQKIIVYYANKQYFFNNETELGAFFIKQLYQHGDLFFSDRNVYTAPIFNLTPESIPVVAVLHSTHIKNIDALDSSPFKNVYKAMFENLSRYRAIIVSTEQQKLDVEKRINHTIPVVNIPVGYSETIDTPVQTLDQRSVKLISVARYSPEKQLHQQIELIKRLVSYVPKIELHMYGFGSESKKLNELIQKYGLENHVYLRGFLSNLDQEYSDAYLSLITSNMEGFSLALLESLAHGVPVISYDIKYGPNELITSDFNGYLITKNDEDALFDKVKYVIDHPEVQQRLSKGSLAKAQQYSKASLIKQWDQFVRLILEHHHHHH

SEQ ID NO: 100 - protein, 868 aa, S. aureus
MAEHTNGELNQSKNETTAPSENKTTKKVDSRQLKDNTQTATADQPKVTMSDSATVKETSSNMQSPQNATANQSTTKTSNVTTNDKSSTTYSNETDKSNLTQAKDVSTTPKTTTIKPRTLNRMAVNTVAAPQQGTNVNDKVHFSNIDIAIDKGHVNQTTGKTEFWATSSDVLKLKANYTIDDSVKEGDTFTFKYGQYFRPGSVRLPSQTQNLYNAQGNIIAKGIYDSTTNTTTYTFTNYVDQYTNVRGSFEQVAFAKRKNATTDKTAYKMEVTLGNDTYSEEIIVDYGNKKAQPLISSTNYINNEDLSRNMTAYVNQPKNTYTKQTFVTNLTGYKFNPNAKNFKIYEVTDQNQFVDSFTPDTSKLKDVTDQFDVIYSNDNKTATVDLMKGQTSSNKQYIIQQVAYPDNSSTDNGKIDYTLDTDKTKYSWSNSYSNVNGSSTANGDQKKYNLGDYVWEDTNKDGKQDANEKGIKGVYVILKDSNGKELDRTTTDENGKYQFTGLSNGTYSVEFSTPAGYTPTTANVGTDDAVDSDGLTTTGVIKDADNMTLDSGFYKTPKYSLGDYVWYDSNKDGKQDSTEKGIKGVKVTLQNEKGEVIGTTETDENGKYRFDNLDSGKYKVIFEKPAGLTQTGTNTTEDDKDADGGEVDVTITDHDDFTLDNGYYEEETSDSDSDSDSDSDSDSDSDSDSDSDSDSDSDSDSDSDSDSDSDSDSDSDSNSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDNDSDSDSDSDSDAGKHTPAKPMSTVKDQHKTAKALEHHHHHH

SEQ ID NO: 101 - protein, 319 aa, S. aureus
MTPKYSLGDYVWYDSNKDGKQDSTEKGIKGVKVTLQNEKGEVIGTTETDENGKYRFDNLDSGKYKVIFEKPAGLTQTGTNTTEDDKDADGGEVDVTITDHDDFTLDNGYYEEETSDSDSDSDSDSDSDSDSDSDSDSDSDSDSDSDSDSDSDSDSDSDSDSDSNSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDNDSDSDSDSDSDAGKHTPAKPMSTVKDQHKTAKALPETGLEHHHHHH

SEQ ID NO: 102 - protein, 453 aa, Homo sapiens
EVMLVESGGGLVQPKGSLKLSCAASGFTFNNYAMNWVRQAPGKGLEWVARIRSKSNNYATFYADSVKDRFTISRDDSQSMLYLQMNNLKTEDTAMYYCVRRGASGIDYAMDYWGQGTSLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 103 - protein, 213 aa, Homo sapiens
DIVLSQSPAILSASPGEKVTMTCRASSSVNYMHWYQQKPGSSPKPWISATSNLASGVPARFSGSGSGTSYSLTISRVEAEDAATYYCQQWSSNPPTFGGGTMLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 104 - protein, 450 aa, Homo sapiens
QITLKESGPTLVKPTQTLTLTCTFSGFSLSTSGMGVSWIRQPPGKALEWLAHIYWDDDKRYNPSLKSRLTITKDTSKNQVVLTMTNMDPVDTATYYCARLYGFTYGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 105 - protein, 218 aa, Homo sapiens
DIVMTQSPDSLAVSLGERATINCRASQSVDYNGISYMHWYQQKPGQPPKLLIYAASNPESGVPDRFSGSGSGTDFTLTISSLQAEDVAVYYCQQIIEDPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 106 - protein, 450 aa, Homo sapiens
QITLKESGPTLVKPTQTLTLTCTFSGFSLSTSGMGVSWIRQPPGKALEWLAHIYWDDDKRYNPSLKSRLTITKDTSKNQVVLTMTNMDPVDTATYYCARLYGFTYGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKAEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 107 - protein, 218 aa, Homo sapiens
DIVMTQSPDSLAVSLGERATINCRASQSVDYNGISYMHWYQQKPGQPPKLLIYAASNPESGVPDRFSGSGSGTDFTLTISSLQAEDVAVYYCQQIIEDPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSLPVTKSFNRGEC

SEQ ID NO: 108 - protein, 291 aa, S. aureus
NSAHHHHHHGSENKIEDIGQGAEIIKRTQDITSKRLAITQNIQFDFVKDKKYNKDALVVKMQGFISSRTTYSDLKKYPYIKRMIWPFQYNISLKTKDSNVDLINYLPKNKIDSADVSQKLGYNIGGNFQSAPSIGGSGSFNYSKTISYNQKNYVTEVESQNSKGVKWGVKANSFVTPNGQVSAYDQYLFAQDPTGPAARDYFVPDNQLPPLIQSGFNPSFITTLSHERGKGDKSEFEITYGRNMDATYAYVTRHRLAVDRKHDAFKNRNVTVKYEVNWKTHEVKIKSITPK

SEQ ID NO: 109 - protein, 310 aa, S. aureus
NSAHHHHHHGSEGKITPVSVKKVDDKVTLYKTTATADSDKFKISQILTFNFIKDKSYDKDTLVLKATGNINSGFVKPNPNDYDFSKLYWGAKYNVSISSQSNDSVNVVDYAPKNQNEEFQVQNTLGYTFGGDISISNGLSGGLNGNTAFSETINYKQESYRTTLSRNTNYKNVGWGVEAHKIMNNGWGPYGRDSFHPTYGNELFLAGRQSSAYAGQNFIAQHQMPLLSRSNFNPEFLSVLSHRQDGAKKSKITVTYQREMDLYQIRWNGFYWAGANYKNFKTRTFKSTYEIDWENHKVKLLDTKETENNK

SEQ ID NO: 110 - protein, 297 aa, S. aureus
NSAHHHHHHGSANDTEDIGKGSDIEIIKRTEDKTSNKWGVTQNIQFDFVKDKKYNKDALILKMQGFISSRTTYYNYKKTNHVKAMRWPFQYNIGLKTNDKYVSLINYLPKNKIESTNVSQTLGYNIGGNFQSAPSLGGNGSFNYSKSISYTQQNYVSEVEQQNSKSVLWGVKANSFATESGQKSAFDSDLFVGYKPHSKDPRDYFVPDSELPPLVQSGFNPSFIATVSHEKGSSDTSEFEITYGRNMDVTHAIKRSTHYGNSYLDGHRVHNAFVNRNYTVKYEVNWKTHEIKVKGQN

SEQ ID NO: 111 - protein, 312 aa, S. aureus
NSAHHHHHHGSAQHITPVSEKKVDDKITLYKTTATSDSDKLKISQILTFNFIKDKSYDKDTLILKAAGNIYSGYTKPNPKDTISSQFYWGSKYNISINSDSNDSVNVVDYAPKNQNEEFQVQQTVGYSYGGDINISNGLSGGGNGSKSFSETINYKQESYRTSLDKRTNFKKIGWDVEAHKIMNNGWGPYGRDSYHSTYGNEMFLGSRQSNLNAGQNFLEYHKMPVLSRGNFNPEFIGVLSRKQNAAKKSKITVTYQREMDRYTNFWNQLHWIGNNYKDENRATHTSIYEVDWENHTVKLIDTQSKEKNPMS

SEQ ID NO: 112 - protein, 295 aa, S. aureus
NSAHHHHHHGSDNNIENIGDGAEVVKRTEDTSSDKWGVTQNIQFDFVKDKKYNKDALILKMQGFINSKTTYYNYKNTDHIKAMRWPFQYNIGLKTNDPNVDLINYLPKNKIDSVNVSQTLGYNIGGNFNSGPSTGGNGSFNYSKTISYNQQNYISEVERQNSKSVQWGIKANSFITSLGKMSGHDPNLFVGYKPYSQNPRDYFVPDNELPPLVHSGFNPSFIATVSHEKGSGDTSEFEITYGRNMDVTHATRRTTHYGNSYLEGSRIHNAFVNRNYTVKYEVNWKTHEIKVKGHN

SEQ ID NO: 113 - protein, 95 aa, Artificial
  Synthetic Luk82 LukE, LukF binding FN3 domain
LPAPKNLVVSRVTEDSARLSWSNRAITTFDSFLIQYQESEKVGEAIVLTVPGSERSYDLTGLKPGTEYTVSIYGVEYRFRPKYTGSNPLSAIFTT

SEQ ID NO: 114 - protein, 94 aa, Artificial
  Synthetic Luk83 LukF binding FN3 domain
LPAPKNLVVSRVTEDSARLSWFRPSEDISSFDSFLIQYQESEKVGEAIVLTVPGSERSYDLTGLKPGTEYTVSIYGVAFPTDAKSNPLSAIFTT

SEQ ID NO: 115 - protein, 89 aa, Artificial
  Synthetic Luk85 LukF binding FN3 domain
LPAPKNLVVSRVTEDSARLSWTAPDAAFDSFHINYNEEALVGEAIVLTVPGSERSCDLTGLKPGTEYGVEIEGVKGGPWSWPLSAIFTT

SEQ ID NO: 116 - protein, 89 aa, Artificial
  Synthetic Luk86 LukE, LukF binding FN3 domain
LPAPKNLVVSRVTEDSARLSWTAPDAAFDSFYIRYNEIDLHGEAIVLTVPGSERSYDLTGLKPGTEYQVPIAGVKVCIISKPLSAIFTT

SEQ ID NO: 117 - protein, 94 aa, Artificial
  Synthetic Luk87 LukE binding FN3 domain
LPAPKNLVVSRVTEDSARLSWANTEPSYFAFDSFLIQYQESEKVGEAIVLTVPGSERSYDLTGLKPGTEYTVSIYGVVWVTWGKSNPLSAIFTT

SEQ ID NO: 118 - protein, 97 aa, Artificial
  Synthetic Luk88 LukE binding FN3 domain
LPAPKNLVVSRVTEDSARLSWTLEWSLIFDSFLIQYQESEKVGEAIVLTVPGSERSYDLTGLKPGTEYTVSIYGVQRSVAWYFLLLASNPLSAIFTT

SEQ ID NO: 119 - protein, 92 aa, Artificial
  Synthetic Luk90 LukE binding FN3 domain
LPAPKNLVVSRVTEDSARLSWRTYPTLFDSFLIQYQESEKVGEAIVLTVPGSERSYDLTGLKPGTEYTVSIYGVWPRNIQPWSNPLSAIFTT

SEQ ID NO: 120 - protein, 96 aa, Artificial
  Synthetic Luk92 LukE binding FN3 domain
LPAPKNLVVSRVTEDSARLSWKRVKWVSYQFDSFLIQYQESEKVGEAIVLTVPGSERSYDLTGLKPGTEYTVSIYGVASIDETVGVSNPLSAIFTT

SEQ ID NO: 121 - protein, 93 aa, Artificial
  Synthetic Luk93 LukE, LukS binding FN3 domain
LPAPKNLVVSRVTEDSARLSWWRRISRFDSFLIQYQESEKVGEAIVLTVPGSERSYDLTGLKPGTEYTVSIYGVDREVYDEWSSNPLSAIFTT

SEQ ID NO: 122 - protein, 97 aa, Artificial
  Synthetic Luk94 LukE binding FN3 domain
LPAPKNLVVSRVTEDSARLSWYRRFLLFIFFDSFLIQYQESEKVGEAIVLTVPGSERSYDLTGLKPGTEYTVSIYGVGEQWGEASDLSNPLSAIFTT

SEQ ID NO: 123 - protein, 93 aa, Artificial
  Synthetic Luk95 LukE binding FN3 domain
LPAPKNLVVSRVTEDSARLSWQHSQYFVLFDSFLIQYQESEKVGEAIVLTVPGSERSYDLTGLKPGTEYTVSIYGVLYRQWRDSNPLSAIFTT

SEQ ID NO: 124 - protein, 95 aa, Artificial
  Synthetic Luk96 LukE binding FN3 domain
LPAPKNLVVSRVTEDSARLSWTAPDAAFDSFLIQYQESEKVGEAIVLTVPGSERSYDLTGLKPGTEYTVSIYGVEHWPSWWHLNFSNPLSAIFTT

SEQ ID NO: 125 - protein, 96 aa, Artificial
  Synthetic Luk97 LukE binding FN3 domain
LPAPKNLVVSRVTEDSARLSWTAPDAAFDSFLIQYQESEKVGEAIVLTVPGSERSYDLTGLKPGTEYTVSIYGVIDIIHINSWNDHSNPLSAIFTT

SEQ ID NO: 126 - protein, 93 aa, Artificial
  Synthetic Luk98 LukE binding FN3 domain
LPAPKNLVVSRVTEDSARLSWNRHSHEFDSFLIQYQESEKVGEAIVLTVPGSERSYDLTGLKPGTEYTVSIYGVRIWVLKLNESNPLSAIFTT

SEQ ID NO: 127 - protein, 89 aa, Artificial
  Synthetic Luk99 LukE binding FN3 domain
LPAPKNLVVSRVTEDSARLSWTAPDAAFDSFEIIYYERHDNGEAIVLTVPGSERSYDLTGLKPGTEYLVWIPGVKGGLTSWPLSAIFTT

SEQ ID NO: 128 - protein, 89 aa, Artificial
  Synthetic Luk100 LukE, LukS binding FN3 domain
LPAPKNLVVSRVTEDSARLSWTAPDAAFDSFPITYGEYRSVGEAIVLTVPGSERSYDLTGLKPGTEYIVDIYGVKGGLFSYPLSAIFTT

SEQ ID NO: 129 - protein, 96 aa, Artificial
  Synthetic Luk101 LukE binding FN3 domain
LPAPKNLVVSRVTEDSARLSWDTEPEWFDSFLIQYQESEKVGEAIVLTVPGSERSYDLTGLKPGTEYTVSIYGVQRVEIRALYRSYSNPLSAIFTT

SEQ ID NO: 130 - protein, 95 aa, Artificial
  Synthetic Luk102 LukE binding FN3 domain
LPAPKNLVVSRVTEDSARLSWTAPDAAFDSFLIQYQESEKVGEAIVLTVPGSERSYDLTGLKPGTEYTVSIYGVSHRFWKHVYFYSNPLSAIFTT

SEQ ID NO: 131 - protein, 96 aa, Artificial
  Synthetic Luk103 LukE binding FN3 domain
LPAPKNLVVSRVTEDSARLSWIIGLSRFDSFLIQYQESEKVGEAIVLTVPGSERSYDLTGLKPGTEYTVSIYGVDFAHQDFFRGYASNPLSAIFTT

SEQ ID NO: 132 - protein, 95 aa, Artificial
  Synthetic Luk104 LukE binding FN3 domain
LPAPKNLVVSRVTEDSARLSWTAPDAAFDSFLIQYQESEKVGEAIVLTVPGSERSYDLTGLKPGTEYTVSIYGVQWWVVAFHHAPSNPLSAIFTT

SEQ ID NO: 133 - protein, 95 aa, Artificial
  Synthetic Luk106 LukE binding FN3 domain
LPAPKNLVVSRVTEDSARLSWTAPDAAFDSFLIQYQESEKVGEAIVLTVPGSERSYDLTGLKPGTEYTVSIYGVVAWIFTKVLNASNPLSAIFTT

SEQ ID NO: 134 - protein, 95 aa, Artificial
  Synthetic Luk107 LukE binding FN3 domain
LPAPKNLVVSRVTEDSARLSWKGPNSPPSQFDSFLIQYQESEKVGEAIVLTVPGSERSYDLTGLKPGTEYTVSIYGVWKWRTRAHSNPLSAIFTT

SEQ ID NO: 135 - protein, 96 aa, Artificial
  Synthetic Luk108 LukE binding FN3 domain
LPAPKNLVVSRVTEDSARLSWFYYYLGKFGFDSFLIQYQESEKVGEAIVLTVPGSERSYDLTGLKPGTEYTVSIYGVVNWRWWPDDSNPLSAIFTT

SEQ ID NO: 136 - protein, 96 aa, Artificial
  Synthetic Luk109 LukE binding FN3 domain
LPAPKNLVVSRVTEDSARLSWTAPDAAFDSFLIQYQESEKVGEAIVLTVPGSERSYDLTGLKPGTEYTVSIYGVIINRFWAWYLASSNPLSAIFTT

SEQ ID NO: 137 - protein, 96 aa, Artificial
  Synthetic Luk110 LukS, LukF binding FN3 domain
LPAPKNLVVSRVTEDSARLSWTAPDAAFDSFLIQYQESEKVGEAIVLTVPGSERSYDLTGLKPGTEYTVSIYGVGFPTFLNYWQFGSNPLSAIFTT

SEQ ID NO: 138 - protein, 89 aa, Artificial
  Synthetic Luk112 HlgA binding FN3 domain
LPAPKNLVVSRVTEDSARLSWTAPDAAFDSFEIHYYEFRHHGEAIVLTVPGSERSYDLTGLKPGTEYAFWIYGVKGGGSSWPLSAIFTT

SEQ ID NO: 139 - protein, 89 aa, Artificial
  Synthetic Luk113 HlgA binding FN3 domain
LPAPKNLVVSRVTEDSARLSWTAPDAAFDSFWIEYHEEYETGEAIVLTVPGSERSYDLTGLKPGTEYWVWIAGVKGGKWSWPLSAIFTT

SEQ ID NO: 140 - protein, 89 aa, Artificial
  Synthetic Luk114 HlgA binding FN3 domain
LPAPKNLVVSRVTEDSARLSWTAPDAAFDSFEIHYQELPQKGEAIVLTVPGSERSYDLTGLKPGTEYVVWIWGVKGGLTSDPLSAIFTT

SEQ ID NO: 141 - protein, 89 aa, Artificial
  Synthetic Luk116 HlgA binding FN3 domain
LPAPKNLVVSRVTEDSARLSWTAPDAAFDSFEIHYQEYPAFGEAIVLTVPGSERSYDLTGLKPGTEYIVWIWGVKGGWTSWPLSAIFTT

SEQ ID NO: 142 - protein, 89 aa, Artificial
  Synthetic Luk117 HlgA binding FN3 domain
LPAPKNLVVSRVTEDSARLSWTAPDAAFDSFEIHYQETISVGEAIVLTVPGSERSYDLTGLKPGTEYWVLIWGVKGGAASDPLSAIFTT

SEQ ID NO: 143 - protein, 89 aa, Artificial
  Synthetic Luk119 HlgA binding FN3 domain
LPAPKNLVVSRVTEDSARLSWTAPDAAFDSFSIDYFEEYQKGEAIVLTVPGSERSYDLTGLKPGTEYWVWIFGVKGGIRSWPLSAIFTT

SEQ ID NO: 144 - protein, 89 aa, Artificial
  Synthetic Luk120 HlgA binding FN3 domain
LPAPKNLVVSRVTEDSARLSWTAPDAAFDSFEINYWEAYIHGEAIVLTVPGSERSYDLTGLKPGTEYWVWIHGVKGGGNSYPLSAIFTT

SEQ ID NO: 145 - protein, 89 aa, Artificial
  Synthetic Luk122 HlgA, LukAB binding FN3 domain
LPAPKNLVVSRVTEDSARLSWTAPDAAFDSFEIHYYEFAIKGEAIVLTVPGSERSYDLTGLKPGTEYAVWIYGVKGGNSSWPLSAIFTT

SEQ ID NO: 146 - protein, 89 aa, Artificial
  Synthetic Luk123 HlgA binding FN3 domain
LPAPKNLVVSRVTEDSARLSWTAPDAAFDSFEIDYFEEYSHGEAIVLTVPGSERSYDLTGLKPGTEYWVWINGVKGGIYSYPLSAIFTT

SEQ ID NO: 147 - protein, 89 aa, Artificial
  Synthetic Luk124 HlgA, LukD binding FN3 domain
LPAPKNLVVSRVTEDSARLSWTAPDAAFDSFTIDYVESYALGEAIVLTVPGSERSYDLTGLKPGTEYWVWIWGVKGGSLSYPMSAIFTT

SEQ ID NO: 148 - protein, 89 aa, Artificial
  Synthetic Luk125 HlgA binding FN3 domain
LPAPKNLVVSRVTEDSARLSWTAPDAAFDSFPIIYYEHHNFGEAIVLTVPGSERSYDLTGLKPGTEYAVPIPGVKGGWQSLPLSAIFTT

SEQ ID NO: 149 - protein, 89 aa, Artificial
  Synthetic Luk126 HlgA binding FN3 domain
LPAPKNLVVSRVTEDSARLSWTAPDAAFDSFYIDYQEWPSVGEAIVLTVPGSERSYDLTGLKPGTEYSVFIHGVKGGWLSKPLSAIFTT

SEQ ID NO: 150 - protein, 89 aa, Artificial
  Synthetic Luk128 HlgA, LukD binding FN3 domain
LPAPKNLVVSRVTEDSARLSWTAPDAAFDSFDIQYFEEYAIGEAIVLTVPGSERSYDLTGLKPGTEYWVWISGVKGGNFSKPLSAIFTT

SEQ ID NO: 151 - protein, 89 aa, Artificial
  Synthetic Luk129 HlgA binding FN3 domain
LPAPKNLVVSRVTEDSARLSWTAPDAAFDSFNINYPEEFHGGEAIVLTVPGSERSYDLTGLKPGTEYEVWIWGVKGGSSSNPLSAIFTT

SEQ ID NO: 152 - protein, 89 aa, Artificial
  Synthetic Luk130 HlgA binding FN3 domain
LPAPKNLVVSRVTEDSARLSWTAPDAAFDSFNIHYLEWEVNGEAIVLTVPGSERSYDLTGLKPGTEYIVEIWGVKGGYSSWPLSAIFTT

SEQ ID NO: 153 - protein, 89 aa, Artificial
  Synthetic Luk132 HlgA binding FN3 domain
LPAPKNLVVSRVTEDSARLSWTAPDAAFDSFYIEYWEWDPVGEAIVLTVPGSERSYDLTGLKPGTEYPVFISGVKGGYPSVPLSAIFTT

SEQ ID NO: 154 - protein, 89 aa, Artificial
  Synthetic Luk133 HlgA binding FN3 domain
LPAPKNLVVSRVTEDSARLSWTAPDAAFDSFIIHYGEGPEFGEAIVLTVPGSERSYDLTGLKPGTEYSVHIPGVKGGWLSWPLSAIFTT

SEQ ID NO: 155 - protein, 89 aa, Artificial
  Synthetic Luk134 HlgA, LukE binding FN3 domain
LPAPKNLVVSRVTEDSARLSWTAPDAAFDSFTIVYLEWVVLGEAIVLTVPGSERSYDLTGLKPGTEYIVDIYGVKGGWTSRPLSAIFTT

SEQ ID NO: 156 - protein, 89 aa, Artificial
  Synthetic Luk136 LukAB, LukD binding FN3 domain
LPAPKNLVVSRVTEDSARLSWTAPDAAFDSFTIDYFEEYVVGEAIVLTVPGSERSYDLTGLKPGTEYWVCIVGVKGGTPSPPLSAIFTT

SEQ ID NO: 157 - protein, 89 aa, Artificial
  Synthetic Luk138 HlgA binding FN3 domain
LPAPKNLVVSRVTEDSARLSWTAPDAAFDSFHIWYQEFEVRGEAIVLTVPGSERSYDLTGLKPGTEYDVEIWGVKGGSHSWTLSAIFTT

SEQ ID NO: 158 - protein, 89 aa, Artificial
  Synthetic Luk139 HlgA, LukAB binding FN3 domain
LPAPKNLVVSRVTEDSARLSWTAPDAAFNSFEIHYGEWEYGGEAIVLTVPGSERSYDLTGLKPGTEYTVWIYGVKGGDSSWPLSAIFTT

SEQ ID NO: 159 - protein, 89 aa, Artificial
  Synthetic Luk140 HlgA binding FN3 domain
LPAPKNLVVSRVTEDSARLSWTAPDAAFDSFEIHYQETKKSGEAIVLTVPGSERSYDLTGLKPGTEYWVLIWGVKGGTASNPLSAIFTT

SEQ ID NO: 160 - protein, 89 aa, Artificial
  Synthetic Luk143 HlgA binding FN3 domain
LPAPKNLVVSRVTEDSARLSWTAPDAAFDSFDIQYDERTEEGEAIVLTVPGSERSYDLTGLKPGTEYFVTIPGVKGGWYSWPLSAIFTT

SEQ ID NO: 161 - protein, 89 aa, Artificial
  Synthetic Luk144 HlgA binding FN3 domain
LPAPKNLVVSRVTEDSARLSWTAPDAAFDSFWIDYFEEWVNGEAIVLTVPGSERSYDLTGLKPGTEYWVWIQGVKGGVHSPPLSAIFTT

SEQ ID NO: 162 - protein, 89 aa, Artificial
  Synthetic Luk148 HlgA binding FN3 domain
LPAPKNLVVSRVTEDSARLSWTAPDAAFDSFEIHYQELNRVGEAIVLTVPGSERSYDLTGLKPGTEYWVLIWGVKGGDSSEPLSAIFTT

SEQ ID NO: 163 - protein, 89 aa, Artificial
  Synthetic Luk151 HlgA binding FN3 domain
LPAPKNLVVSRVTEDSARLSWTAPDAAFDSFGITYTEVYWWGEAIVLTVPGSERSYDLTGLKPGTEYTVTIPGVKGGWISAPLSAIFTT

SEQ ID NO: 164 - protein, 89 aa, Artificial
  Synthetic Luk155 HlgA binding FN3 domain
LPAPKNLVVSRVTEDSARLSWTAPDAAFDSFSIRYFEFIKPGEAIWLGVPGSERSYDLTGLKPGTEYHVQIRGVKGGRESYPLWADFTT

SEQ ID NO: 165 - protein, 89 aa, Artificial
  Synthetic Luk156 HlgA binding FN3 domain
LPAPKNLVVSRVTEDSARLSWTAPDAAFDSFEIQYHETRYSGEAIWLWVPGSERSYDLTGLKPGTEYSVYIPGVKGGNVSFPLKAHFTT

SEQ ID NO: 166 - protein, 89 aa, Artificial
  Synthetic Luk158 HlgA binding FN3 domain
LPAPKNLVVSRVTEDSARLSWTAPDAAFDSFAISYKESGRIGEAISLIVPGSERSYDLTGLKPGTEYWVYINGVKGGITSFPLNAWFTT

SEQ ID NO: 167 - protein, 89 aa, Artificial
  Synthetic Luk159 HlgA, LukAB binding FN3 domain
LPAPKNLVVSRVTEDSARLSWTAPDAAFDSFGIDYKETGYTGEAIELEVPGSEHSYDLTGLKPGTEYFVTIGGVKGGYSSWPLVALFTT

SEQ ID NO: 168 - protein, 89 aa, Artificial
  Synthetic Luk160 HlgA binding FN3 domain
LPAPKNLVVSRVTEDSARLSWTAPDAAFDSFVIWYTENPSLGEAIKLSVPGSERSYDLTGLKPGTEYVVEIWGVKGGRGSVPLFAIFTT

SEQ ID NO: 169 - protein, 89 aa, Artificial
  Synthetic Luk163 HlgA binding FN3 domain
LPAPKNLVVSRVTEDSARLSWTAPDAAFDSFYIEYWEPTSDGEAIALNVPGSERSYDLTGLKPGTEYFVEIWGVKGGPRSPPLSAWFTT

SEQ ID NO: 170 - protein, 89 aa, Artificial
  Synthetic Luk164 HlgA binding FN3 domain
LPAPKNLVVSRVTEDSARLSWTAPDAAFDSFDIEYGEPEKIGEAIWLTVPGSERSYDLTGLKPGTEYWVFIYGVKGGALSRPLTATSTT

SEQ ID NO: 171 - protein, 89 aa, Artificial
  Synthetic Luk166 HlgA binding FN3 domain
LPAPKNLVVSRVTEDSARLSWTAPDAAFDSFWIQYFEIQPWGEAILLDVPGSERSYDLTGLKPGTEYSVIIWGVKGGPKSQPLYAWFTT

SEQ ID NO: 172 - protein, 89 aa, Artificial
  Synthetic Luk167 LukD binding FN3 domain
LPAPKNLVVSRVTEDSARLSWTAPDAAFDSFVIIYSEDTIPGEAIVLWVPGSERSYDLTGLKPGTEYYVQIEGVKGGHESFPLVANFTT

SEQ ID NO: 173 - protein, 89 aa, Artificial
  Synthetic Luk174 HlgA binding FN3 domain
LPAPKNLVVSRVTEDSARLSWTAPDAAFDSFDIEYGEPEKIGEAIWLTVPGSERSYDLTGLKPGTEYWVFIYGVKGGALSRPLTATFTT

SEQ ID NO: 174 - protein, 89 aa, Artificial
  Synthetic Luk176 HlgA binding FN3 domain
LPAPKNLVVSRVTEDSARLSWTAPDAAFDSFVIYYHEFPYGGEAIVLTVPGSERSYDLTGLKPGTEYYVRILGVKGGGLSYPLSAIFTT

SEQ ID NO: 175 - protein, 87 aa, Artificial
  Synthetic Luk177 LukD binding FN3 domain
LPAPKNLVVSRVTEDSARLSWTAPDAAFDSFAIYYREWGSGEAIVLTVPGSERSYDLTGLKPGTEYLVITGVKGGNPSYPLSAIFTT

SEQ ID NO: 176 - protein, 89 aa, Artificial
  Synthetic Luk178 HlgA binding FN3 domain
LPAPKNLVVSRVTEDSARLSWTAPDAAFDSFAIHYFEAYAGGEAIVLTVPGSERSYDLTGLKPGTEYWVWIFGVKGGLYSYPLSAIFTT

SEQ ID NO: 177 - protein, 89 aa, Artificial
  Synthetic Luk179 HlgA binding FN3 domain
LPAPKNLVVSRVTEDSARLSWTAPDAAFDSFEINYFEAWDGGEAIVLTVPGSERSYDLTGLKPGTEYWVWISGVKGGRYSYPLSAIFTT

SEQ ID NO: 178 - protein, 89 aa, Artificial
  Synthetic Luk180 HlgA binding FN3 domain
LPAPKNLVVSRVTEDSARLSWTAPDAAFDSFEIHYYEPIYVGEAIVLTVPGSERSYDLTGLKPGTEYIVWIYGVKGGYSSWPLSAIFTT

SEQ ID NO: 179 - protein, 89 aa, Artificial
  Synthetic Luk182 HlgC binding FN3 domain
LPAPKNLVVSRVTEDSARLSWTAPDAAFDSFYILYIENDWQGEAIVLTVPGSERSYDLTGLKPGTEYFVVIHGVKGGWISPPLSAIFTT

SEQ ID NO: 180 - protein, 89 aa, Artificial
  Synthetic Luk183 HlgC binding FN3 domain
LPAPKNLVVSRVTEDSARLSWTAPDAAFDSFTIWYWEFLHNGEAIVLTVPGSERSYDLTGLKPGTEYFVEIYGVKGGSVSVPLSAIFTT

SEQ ID NO: 181 - protein, 89 aa, Artificial
  Synthetic Luk184 HlgC binding FN3 domain
LPAPKNLVVSRVTEDSARLSWTAPDAAFDSFTIIYHELNTAGEAIVLTVPGSERSYDLTGLKPGTEYLVIIHGVKGGPISSPLSAIFTT

SEQ ID NO: 182 - protein, 89 aa, Artificial
  Synthetic Luk185 HlgC, LukS binding FN3 domain
LPAPKNLVVSRVTEDSARLSWTAPDAAFDSFRIVYREWFHYGEAIVLTVPGSERSYDLTGLKPGTEYYVVIHGVKGGYISKPLSAIFTT

SEQ ID NO: 183 - protein, 89 aa, Artificial
  Synthetic Synthetic Luk186 HlgC binding FN3 domain
LPAPKNLVVSRVTEDSARLSWTAPDAAFDSFHITYTEYSFVGEAIVLTVPGSERSYDLTGLKPGTEYFVEIYGVKGGFISSPLSAIFTT

SEQ ID NO: 184 - protein, 89 aa, Artificial
  Synthetic Luk187 HlgC binding FN3 domain
LPAPKNLVVSRVTEDSARLSWTAPDAAFDSFRILYFEYKRLGEAIVLTVPGSERSYDLTGLKPGTEYFVGIHGVKGGYISRPLSAIFTT

SEQ ID NO: 185 - protein, 89 aa, Artificial
  Synthetic Luk188 HlgC binding FN3 domain
LPAPKNLVVSRVTEDSARLSWTAPDAAFDSFHIHYWEFNPAGEAIVLTVPGSERSYDLTGLKPGTEYFVGIHGVKGGGISWPLSAIFTT

SEQ ID NO: 186 - protein, 89 aa, Artificial
  Synthetic Luk189 HlgC binding FN3 domain
LPAPKNLVVSRVTEDSARLSWTAPDAAFDSLKIFYFEFIYLGEAIVLTVPGSERSYDLTGLKPGTEYHVTIHGVKGGTISLPLSAIFTT

SEQ ID NO: 187 - protein, 89 aa, Artificial
  Synthetic Luk190 HlgC, LukS binding FN3 domain
LPAPKNLVVSRVTEDSARLSWTAPDAAFDSFHIFYYEFSNYGEAIVLTVPGSERSYDLTGLKPGTEYFVIIHGVKGGQISVPLSAIFTT

SEQ ID NO: 188 - protein, 88 aa, Artificial
  Synthetic Luk191 HlgC, LukS binding FN3 domain
LPAPKNLVVSRVTEDSARLSWTAPDAAFDSFTIFYWEWYHGEAIVLTVPGSERSYDLTGLKPGTEYNVVIHGVKGGYISLPLSAIFTT

SEQ ID NO: 189 - protein, 89 aa, Artificial
  Synthetic Luk192 HlgC binding FN3 domain
LPAPKNLDVSRVTEDSARLSWTAPDAAFDSFVIFYYEEKPIGEAIVLTVPGSERSYDLTGLKPGTEYFVEIYGVKGGYISNPLSAIFTT

SEQ ID NO: 190 - protein, 89 aa, Artificial
  Synthetic Luk193 HlgC, LukS binding FN3 domain
LPAPKNLVVSRVTEDSARLSWTAPDAAFDSFNIFYHETRPLGEAIVLTVPGSERSYDLTGLKPGTEYLVAIYGVKGGYISLPLSAIFTT

SEQ ID NO: 191 - protein, 89 aa, Artificial
  Synthetic Luk194 HlgC binding FN3 domain
LPAPKNLVVSRVTEDSARLSWTAPDAAFDSFTIHYWEFSDNGEAIVLTVPGSERSYDLTGLKPGTEYLVGIYGVKGGQISQPLSAIFTT

SEQ ID NO: 192 - protein, 89 aa, Artificial
  Synthetic Luk195 HlgC, LukD binding FN3 domain
LPAPKNLVVSRVTEDSARLSWTAPDAAFDSFHIIYYEYPAGGEAIVLTVPGSERSYDLTGLKPGTEYHVIIHGVKGGFVSVPLSAIFTT

SEQ ID NO: 193 - protein, 89 aa, Artificial
  Synthetic Luk196 HlgC, LukS binding FN3 domain
LPAPKNLVVSRVTEDSARLSWTAPDAAFDSFNIIYIENPYWGEAIVLTVPGSERSYDLTGLKPGTEYFVIIHGVKGGYISEPLSAIFTT

SEQ ID NO: 194 - protein, 89 aa, Artificial
  Synthetic Luk197 HlgC, LukS binding FN3 domain
LPAPKNLVVSRVTEDSARLSWTAPDAAFDSFTILYWEVQANGEAIVLTVPGSERSYDLTGLKPGTEYVVGIYGVKGGYISLPLSAIFTT

SEQ ID NO: 195 - protein, 89 aa, Artificial
  Synthetic Luk198 HlgC, LukS binding FN3 domain
LPAPKNLVVSRVTEDSARLSWTAPDAAFDSFQIFYTEEKTWGEAIVLTVPGSERSYDLTGLKPGTEYFVWIHGVKGGWISAPLSAIFTT

SEQ ID NO: 196 - protein, 89 aa, Artificial
  Synthetic Luk199 HlgC, LukS binding FN3 domain
LPAPKNLVVSRVTEDSARLSWTAPDAAFDSFTILYAEHSNKGEAIVLTVPGSERSYDLTGLKPGTEYFVGIYGVKGGFISWPLSAIFTT

SEQ ID NO: 197 - protein, 89 aa, Artificial
  Synthetic Luk201 HlgC, LukS binding FN3 domain
LPAPKNLVVSRVTEDSARLSWTAPDAAFDSFTIFYLEHNDEGEAIVLTVPGSERSYDLTGLKPGTEYWVAIHGVKGGYISQPLSAIFTT

SEQ ID NO: 198 - protein, 88 aa, Artificial
  Synthetic Luk202 HlgC binding FN3 domain
LPAPKNLVVSRVTEDSARLSWTAPDAAFDSFRIWYHETWRGEAIVLTVPGSERSYDLTGLKPGTEYPVVIHGVKGGFISTPLSAIFTT

SEQ ID NO: 199 - protein, 89 aa, Artificial
  Synthetic Luk203 HlgC binding FN3 domain
LPAPKNLVVSRVTEDSARLSWTAPDAAFDSFTIIYVEYETWGEAIVLTVPGSERSYDLTGLKPGTEYIVAIHGVKGGYISIPLSAIFTT

SEQ ID NO: 200 - protein, 89 aa, Artificial
  Synthetic Luk204 HlgC binding FN3 domain
LPAPKNLVVSRVTEDSARLSWTAPDAAFDSFPIIYWELWSIGEAIVLTVPGSERSYDLTGLKPGTEYFVEIYGVKGGTISTPLSAIFTT

SEQ ID NO: 201 - protein, 89 aa, Artificial
  Synthetic Luk205 HlgC binding FN3 domain
LPAPKNLVVSRVTEDSARLSWTAPDAAFDSFSILYWEWVANGEAIVLTVPGSERSYDLTGLKPGTEYFVEIYGVKGGWLSLPLSAIFTT

SEQ ID NO: 202 - protein, 89 aa, Artificial
  Synthetic Luk206 HlgC binding FN3 domain
LPAPKNLVVSRVTEDSARLSWTAPDAAFDSFAIFYFEQFSRGEAIVLTVPGSERSYDLTGLKPGTEYFVAIHGVKGGFVSRPLSAIFTT

SEQ ID NO: 203 - protein, 89 aa, Artificial
  Synthetic Luk208 HlgC binding FN3 domain
LPAPKNLVVSRVTEDSARLSWTAPDAAFDSFTIWYWEWYHLGEAIVLTVPGSELSYDLTGLKPGTEYWVEIYGVKGGFISQPLSAIFTT

SEQ ID NO: 204 - protein, 89 aa, Artificial
  Synthetic Luk210 HlgC, LukS binding FN3 domain
LPAPKNLVVSRVTEDSARLSWTAPDAAFDSFPIFYFEYLGNGEAIVLTVPGSERSYDLTGLKPGTEYFVGIHGVKGGVISTPLSAIFTT

SEQ ID NO: 205 - protein, 89 aa, Artificial
  Synthetic Luk211 HlgC binding FN3 domain
LPAPKNLVVSRVTEDSARLSWTAPDAAFDSFTIIYFEWKRLGEAIVPTVPGSERSYDLTGLKPGTEYWVGIYGVKGGPISVPLSAIFTT

SEQ ID NO: 206 - protein, 89 aa, Artificial
  Synthetic Luk212 HlgC binding FN3 domain
LPAPKNLVVSRVTEDSARLSWTAPDAAFDSFTILYTEREFYGEAIVLTVPGSERSYDLTGLKPGTEYWVGIYGVKGGNISEPLSAIFTT

SEQ ID NO: 207 - protein, 89 aa, Artificial
  Synthetic Luk213 HlgC, LukS binding FN3 domain
LPAPKNLVVSRVTEDSARLSWTAPDAAFDSFHIFYHETDAYGEAIVLTVPGSERSYDLTGLKPGTEYFVVIHGVKGGFISSPLSAIFTT

SEQ ID NO: 208 - protein, 89 aa, Artificial
  Synthetic Luk214 HlgC binding FN3 domain
LPAPKNLVVSRVTEDSARLSWTAPDAAFDSFAIHYWEYDANGEAIVLTVPGSERSYDLTGLKPGTEYLVAIYGVKGGLISVPLSAIFTT

SEQ ID NO: 209 - protein, 89 aa, Artificial
  Synthetic Luk215 HlgC, LukS binding FN3 domain
LPAPKNLVVSRVTEDSARLSWTAPDAAFDSFTILYHESVTNGEAIVLTVPGSERSYDLTGLKPGTEYLVGIYGVKGGYISDPLSAIFTT

SEQ ID NO: 210 - protein, 89 aa, Artificial
  Synthetic Luk216 HlgC, LukS binding FN3 domain
LPAPKNLVVSRVTEDSARLSWTAPDAAFDSFRIHYFEESITGEAIVLTVPGSERSYDLTGLKPGTEYFVAIYGVKGGSISDPLSAIFTT

SEQ ID NO: 211 - protein, 89 aa, Artificial
  Synthetic Luk218 HlgC binding FN3 domain
LPAPKNLVVSRVTEDSARLSWTAPDAAFDSFSIIYWEYRWQGEAIVLTVPGSERSYDLTGLKPGTEYIVPIHGVKGGEISPPLSAIFTT

SEQ ID NO: 212 - protein, 89 aa, Artificial
  Synthetic Luk219 HlgC binding FN3 domain
LPAPKNLVVSRVTEDSARLSWTAPDAAFDSFTIWYWVYRTSGEAIVLTVPGSERSYDLTGLKPGTEYFVAIHGVKGGEISVPLSAIFTT

SEQ ID NO: 213 - protein, 89 aa, Artificial
  Synthetic Luk220 HlgC, LukS binding FN3 domain
LPAPKNLVVSRVTEDSARLSWTAPDAAFDSFAIFYWEESPPGEAIVLTVPGSERSYDLTGLKPGTEYLVAIYGVKGGYISLPLSAIFTT

SEQ ID NO: 214 - protein, 89 aa, Artificial
  Synthetic Luk221 HlgC, LukS, LukD, LukAB binding FN3 domain
LPAPKNLVVSRVTEDSARLSWTAPDAAFDSFAIFYHELEHHGEAIVLTVPGSERSYDLTGLKPGTEYFVAIHGVKGGQISWPLSAIFTT

SEQ ID NO: 215 - protein, 88 aa, Artificial
  Synthetic Luk222 HlgC, LukS binding FN3 domain
LPAPKNLVVSRVTEDSARLSWTAPDAAFDSFSILYWEEEFGEAIVLTVPGSERSYDLTGLKPGTEYFVAIHGVKGGYISRPLSAIFTT

SEQ ID NO: 216 - protein, 89 aa, Artificial
  Synthetic Luk223 HlgC, LukS binding FN3 domain
LPAPKNLVVSRVTEDSARLSWTAPDAAFDSFVILYWEEENQGEAIVLTVPGSERSYDLTGLKPGTEYFVAIHGVKGGHISEPLSAIFTT

SEQ ID NO: 217 - protein, 89 aa, Artificial
  Synthetic Luk224 HlgC, LukS binding FN3 domain
LPAPKNLVVSRVTEDSARLSWTAPDAAFDSFTIFYTEHGVSGEAIVLTVPGSERSYDLTGLKPGTEYWVPIHGVKGGTISQPLSAIFTT

SEQ ID NO: 218 - protein, 89 aa, Artificial
  Synthetic Luk225 HlgC binding FN3 domain
LPAPKNLVVSRVTEDSARLSWTAPDAAFDSFQIFYHEFLTIGEAIVLTVPGSERSYDLTGLKPGTEYIVAIYGVKGGQISDPLSAIFTT

SEQ ID NO: 219 - protein, 89 aa, Artificial
  Synthetic Luk226 HlgC binding FN3 domain
LPAPKNLVVSRVTEDSARLSWTAPDAAFDSFTIHYAEWHLDGEAIVLTVPGSERSYDLTGLKPGTEYFVAIHGVKGGYISEPLSAIFTT

SEQ ID NO: 220 - protein, 89 aa, Artificial
  Synthetic Luk227 HlgC binding FN3 domain
LPAPKNLVVSRVTEDSARLSWTAPDAAFDSFRIYYHEWQATGEAIVLTVPGSERSYDLTGLKPGTEYLVVIHGVKGGWISSPLSAIFTT

SEQ ID NO: 221 - protein, 89 aa, Artificial
  Synthetic Luk228 HlgC, LukS binding FN3 domain
LPAPKNLVVSRVTEDSARLSWTAPDAAFDSFTIPYYEYAVFGEATVLTVPGSERSYDLTGLKPGTEYHVIIHGVKGGYISLPLSAIFTT

SEQ ID NO: 222 - protein, 89 aa, Artificial
  Synthetic Luk229 HlgC, LukS binding FN3 domain
LPAPKNLVVSRVTEDSARLSWTAPDAAFDSFYIFYLEWNQIGEAIVLTVPGSERSYDLTGLKPGTEYFVAIYGVKGGFISDPLSAIFTT

SEQ ID NO: 223 - protein, 89 aa, Artificial
  Synthetic Luk230 HlgC binding FN3 domain
LPAPKNLVVSRVTEDSARLSWTAPDAAFDSFIIFYTESHFYGEAIVLTVPGSERSYDLTGLKPGTEYWVAIYGVKGGEFSFPLSAIFTT

SEQ ID NO: 224 - protein, 89 aa, Artificial
  Synthetic Luk231 HlgC, LukS binding FN3 domain
LPAPKNLVVSRVTEDSARLSWTAPDAAFDSFRILYWEYVTAGEAIVLTVPGSERSYDLTGLKPGTEYFVVIHGVKGGYISIPLSAIFTT

SEQ ID NO: 225 - protein, 89 aa, Artificial
  Synthetic Luk233 HlgC binding FN3 domain
LPAPKNLVVSRVTEDSACLSWTAPDAAFDSFAIQYWEYSGIGEAIVLTVPGSERSYGLTGLKPGTEYFVGIAGVKGGWISLPLSAIFTT

SEQ ID NO: 226 - protein, 89 aa, Artificial
  Synthetic Luk235 HlgC, LukAB binding FN3 domain
LPAPKNLVVSRVTEDSARLSWTAPDAAFDSFSIIYHEWDKNGEAIVLTVPGSERSYDLTGLKPGTEYFVAIYGVKGGYISRPLSAIFTT

SEQ ID NO: 227 - protein, 89 aa, Artificial
  Synthetic Luk236 HlgC, LukS binding FN3 domain
LPAPKNLVVSRVTEDSARLSWTAPDAAFDSFNIFYWEYILPGEAIVLTVPGSERSYDLTGLKPGTEYWVIIHGVKGGHISDPLSAIFTT

SEQ ID NO: 228 - protein, 90 aa, Artificial
  Synthetic Luk237 HlgC binding FN3 domain
MLPPPKNLVVSRVTEDSARLSWTAPDAAFDSFQIIYWEYAETGEAIVLTVPGSERSYDLTGLKPGTEYIVIIHGVKGGEISRPLSAIFTT

SEQ ID NO: 229 - protein, 89 aa, Artificial
  Synthetic Luk238 HlgC, LukS binding FN3 domain
LPAPKNLVVSRVTEDSARLSWTAPDAAFDSFAIFYHETVKSGEAIVLTVPGSERSYDLTGLKPGTEYFVVIHGVKRGQISEPLSAIFTT

SEQ ID NO: 230 - protein, 89 aa, Artificial
  Synthetic Luk239 HlgC binding FN3 domain
LPAPKNLVVSRVTEDSARLSWTAPDAAFDSFHISYWEYAVYGEAIVLTVPGSERSYDLTGLKPGTEYFVGIYGVKGGWISSPLSAIFTT

SEQ ID NO: 231 - protein, 89 aa, Artificial
  Synthetic Luk240 HlgC, LukS binding FN3 domain
LPAPKNLVVSRVTEDSARLSWTAPDAAFDSFPIFYDEEAHNGEAIVLTVPGSERSYDLTGLKPGTEYFVVIHGVKGGTISIPLSAIFTT

SEQ ID NO: 232 - protein, 89 aa, Artificial
  Synthetic Luk241 HlgC, LukS binding FN3 domain
LPAPKNLVVSRVTEDSARLSWTAPDAAFDSFTIYYFESYAVGEAIVLTVPGSERSYDLTGLKPGTEYFVAIYGVKGGWISWPLSAIFTT

SEQ ID NO: 233 - protein, 89 aa, Artificial
  Synthetic Luk242 HlgC, LukS binding FN3 domain
LPAPKNLVVSRVTEDSARLSWTAPDAAFDSFVIFYHETEVDGEAIVLTVPGSERSYDLTGLKPGTEYVVIIHGVKGGFISYPLSAIFTT

SEQ ID NO: 234 - protein, 89 aa, Artificial
  Synthetic Luk243 HlgC binding FN3 domain
LPAPKNLVVSRVTEDSARLSWTAPDAAFDSFQIMYFEFQALGEAIVLTVPGSERSYDLTGLKPGTEYLVLIHGVKGGLISPPLSAIFTT

SEQ ID NO: 235 - protein, 89 aa, Artificial
  Synthetic Luk244 HlgC binding FN3 domain
LPAPKNLVVSRVTEDSARLSWTAPDAAFDSFNIYYWEFLENGEAIVLTVPGSERSYDLTGLKPGTEYFVAIHGVKGGFISWPLSAIFTT

SEQ ID NO: 236 - protein, 89 aa, Artificial
  Synthetic Luk245 HlgC binding FN3 domain
LPAPKNLVVSRVTEDSARLSWTAPDAAFDSFTIHYWEFRPGGEAIVLTVPGSERSYDLTGLKPGTEYFVAIFGVKGGSISVPLSAIFTT

SEQ ID NO: 237 - protein, 89 aa, Artificial
  Synthetic Luk246 HlgC, LukS binding FN3 domain
LPAPKNLVVSRVTEDSARLSWTAPDAAFDSFVIHYFEASPPGEAIVLTVPGSERSYDLTGLKPGTEYYVVIYGVKGGYISPPLSAIFTT

SEQ ID NO: 238 - protein, 89 aa, Artificial
  Synthetic Luk247 HlgC, LukS binding FN3 domain
LPAPKNLVVSRVTEDSARLSWTAPDAAFDSFTIFYHEYVQVGEAIVLTVPGSERSYDLTGLKPGTEYFVAIYGVKGGQISDPLSAIFTT

SEQ ID NO: 239 - protein, 89 aa, Artificial
  Synthetic Luk248 HlgC binding FN3 domain
LPAPKNLVVSRVTEDSARLSWTAPDAAFDSFNIIYWEYVDVGEAIVLTVPGSERSYDLTGLKPGTEYLVPIYGVKGGLISEPLSAIFTT

SEQ ID NO: 240 - protein, 89 aa, Artificial
  Synthetic Luk249 HlgC binding FN3 domain
LPAPKNLVVSRVTEDSARLSWTAPDAAFDSFAIVYWEQKFYGEAIVLTVPGSERSYDLTGLKPGTEYFVGIYGVKGGFISLPLSAIFTT

SEQ ID NO: 241 - protein, 89 aa, Artificial
  Synthetic Luk250 HlgC, LukS binding FN3 domain
LPAPKNLVVSRVTEDSARLSWTAPDAAFDSFVIFYDEWRGVGEAIVLTVPGSERSYDLTGLKPGTEYFVPIQGVKGGYVSDPLSAIFTT

SEQ ID NO: 242 - protein, 89 aa, Artificial
  Synthetic Luk251 HlgC, LukS binding FN3 domain
LPAPKNLVVSRVTEDSARLSWTAPDAAFDSFAIHYHEYQQIGEAIVLTVPGSERSYDLIGLKPGTEYFVAIYGVKGGFISQPLSAIFTT

SEQ ID NO: 243 - protein, 89 aa, Artificial
  Synthetic Luk252 HlgC, LukS binding FN3 domain
LPAPKNLVVSRVTEDSARLSWTAPDAAFDSFAIFYLEWPAKGEAIVLTVPGSERSYDLTGLKPGTEYFVVIHGVKGGWISPPLSAIFTT

SEQ ID NO: 244 - protein, 89 aa, Artificial
  Synthetic Luk253 HlgC binding FN3 domain
LPAPKNLVVSRVTEDSARLSWTAPDAAFDSFNIVYWEYNPVGEAIVLTVPGSERSYDLTGLKPGTEYFVGIYGVKGGNISKPLSAIFTT

SEQ ID NO: 245 - protein, 89 aa, Artificial
  Synthetic Luk254 HlgC, LukS binding FN3 domain
LPAPKNLVVSRVTEDSARLSWTAPDAAFDSFGIFYLEHDWRGEAIVLTVPGSERSYDLTGLKPGTEYLVIIHGVKGGSISVPLSAIFTT

SEQ ID NO: 246 - protein, 89 aa, Artificial
  Synthetic Luk255 HlgC, LukS binding FN3 domain
LPAPKNLVVSRVTEDSARLSWTAPDAAFDSFTILYWEYEQQGEAIVLTVPGSERSYDLTGLKPGTEYFVAIHGVKGGEISQPLSAIFTT

SEQ ID NO: 247 - protein, 89 aa, Artificial
  Synthetic Luk257 LukD, LukAB binding FN3 domain
LPAPKNLVVSRVTEDSARLSWTAPDAAFDSFTIIYIEHVDWGEAIVLTVPGSERSYDLTGLKPGTEYFVEIYGVKGGKISAPLSAIFTT

SEQ ID NO: 248 - protein, 89 aa, Artificial
  Synthetic Luk258 HlgC binding FN3 domain
LPAPKNLVVSRVTEDSARLSWTAPDAAFDSFTIYYFESVDWGEAIVLTVPGSERSYDLTGLKPGTEYYVYIYGVKGGWISVPLSAIFTT

SEQ ID NO: 249 - protein, 89 aa, Artificial
  Synthetic Luk259 HlgC, LukS binding FN3 domain
LPAPKNLVVSRVTEDSARLSWTAPDAAFDSFQIIYWESQYWGEAIVLTVPGSERSYDLTGLKPGTEYIVVIHGVKGGGISDPLSAIFTT

SEQ ID NO: 250 - protein, 89 aa, Artificial
  Synthetic Luk260 HlgC, LukS binding FN3 domain
LPAPKNLVVSRVTEDSARLSWTAPDAAFDSFRIIYYEWESAGEAIVLTVPGSERSYDLTGLKPGTEYFVAIHGVKGGFISFPLSAIFTT

SEQ ID NO: 251 - protein, 89 aa, Artificial
  Synthetic Luk261 HlgC binding FN3 domain
LPAPKNLVVSRVTEDSARLSWTAPDAAFDSFNIFYWEFQKKGEAIVLTVPGSERSYDLTGLKPGTEYIVIIYGVKGGFISPPLSAIFTT

SEQ ID NO: 252 - protein, 89 aa, Artificial
  Synthetic Luk262 HlgC binding FN3 domain
LPAPKNLVVSRVTEDSARLSWTAPDAAFDSFHIFYLEKTNYGEAIVLTVPGSERSYDLTGLKPGTEYLVIIHGVKGGPISGPLSAIFTT

SEQ ID NO: 253 - protein, 89 aa, Artificial
  Synthetic Luk263 HlgC binding FN3 domain
LPAPKNLVVSRVTEDSARLSWTAPDAAFDSFGIWYWEYVRNGEAIVLTVPGSERSYDLTGLKPGTEYFVPIYGVKGGDTSPPLSAIFTT

SEQ ID NO: 254 - protein, 89 aa, Artificial
  Synthetic Luk264 HlgC, LukS binding FN3 domain
LPAPKNLVVSRVTEDSARLSWTAPDAAFDSFVIFYHEYFTVGEAIVLTVPGSERSYDLTGLKPGTEYFVAIHGVKGGLISAPLSAIFTT

SEQ ID NO: 255 - protein, 89 aa, Artificial
  Synthetic Luk265 HlgC binding FN3 domain
LPAPKNLVVSRVTEDSARLSWTAPDAAFDSFQIIYFENEYGGEAIVLTVPGSERSYDLTGLKPGTEYFVAIYGVKGGYLSVPLSAIFTT

SEQ ID NO: 256 - protein, 89 aa, Artificial
  Synthetic Luk266 HlgC binding FN3 domain
LPAPKNLVVSRVTEDSARLSWTAPDAAFDSFRIGYLENPWDGEAIVLTVPGSERSYDLTGLKPGTEYFVFIYGVKGGHISNPLSAIFTT

SEQ ID NO: 257 - protein, 89 aa, Artificial
  Synthetic Luk267 HlgC binding FN3 domain
LPAPKNLVVSRVTEDSARLSWTAPDAAFDSFIIHYFEYEPPGEAIVLTVPGSERSYDLTGLKPGTEYFVGIYGVKGGWVSEPLSAIFTT

SEQ ID NO: 258 - protein, 89 aa, Artificial
  Synthetic Luk268 HlgC, LukS binding FN3 domain
LPAPKNLVVSRVTEDSARLSWTAPDAAFDSFTIFYPEYSARGEAIVLTVPGSERSYDLTGLKPGTEYFVVIHGVKGGFVSEPLSAIFTT

SEQ ID NO: 259 - protein, 89 aa, Artificial
  Synthetic Luk269 HlgC binding FN3 domain
LPAPKNLVVSRVTEDSARLSWTAPDAAFDSFNIIYWEYEVAGEAIVLTVPGSERSYDLTGLKPGTEYFVSIQGVKGGAISPPLSAIFTT

SEQ ID NO: 260 - protein, 89 aa, Artificial
  Synthetic Luk270 HlgC binding FN3 domain
LPAPKNLVVSRVTEDSARLSWTAPDAAFDSFQIVYFEHPSYGEAIVLTVPGSERSYDLTGLKPGTEYFVGIYGVKGGEISAPLSAIFTT

SEQ ID NO: 261 - protein, 89 aa, Artificial
  Synthetic Luk271 HlgC binding FN3 domain
LPAPKNLVVSRVTEDSARLSWTAPDAAFDSFNIVYFEWAANGEAIVLTVPGSERSYDLTGLKPGTEYFVGIYGVKGGAISLPLSAIFTT

SEQ ID NO: 262 - protein, 89 aa, Artificial
  Synthetic Luk272 HlgC, LukS binding FN3 domain
LPAPKNLVVSRVTEDSARLSWTAPDAAFDSFNIFYWEDTLKGEAIVLTVPGSERSYDLTGLKPGTEYVVAIHGVKGGTISHPLSAIFTT

SEQ ID NO: 263 - protein, 89 aa, Artificial
  Synthetic Luk273 HlgC binding FN3 domain
LPAPKNLVVSRVTEDSARLSWTAPDAAFDSFVINYWEFQPAGEAIVLTVPGSERSYDLTGLKPGTEYFVAIHGVKGGQISKPLSAIFTT

SEQ ID NO: 264 - protein, 89 aa, Artificial
  Synthetic Luk274 HlgC, LukS binding FN3 domain
LPAPKNLVVSRVTEDSARLSWTAPDAAFDSFTIIYWELVWNGEAIVLTVPGSERSYDLTGLKPGTEYCVPIHGVKGGLISPPLSAIFTT

SEQ ID NO: 265 - protein, 89 aa, Artificial
  Synthetic Luk275 HlgC, LukS, LukD binding FN3 domain
LPAPKNLVVSRVTEDSARLSWTAPDAAFDSFVIFYEEWQVGGEAIVLTVPGSERSYDLTGLKPGTEYFVAIYGVKGGAISQPLSAIFTT

SEQ ID NO: 266 - protein, 89 aa, Artificial
  Synthetic Luk276 HlgC binding FN3 domain
LPAPKNLVVSRVTEDSARLSWTAPDAAFDSFYIHYFEYEIRGEAIVLTVPGSERSYDLTGLKPGTEYFVSIYGVKGGLISSPLSAIFTT

SEQ ID NO: 267 - protein, 89 aa, Artificial
  Synthetic Luk277 HlgC, LukS binding FN3 domain
LPAPKNLVVSRVTEDSARLSWTAPDAAFDSFTIFYLEYDQGGEAIVLTVPGSERSYDLTGLKPGTEYLVTIHGVKGGYISEPLSAIFTT

SEQ ID NO: 268 - protein, 89 aa, Artificial
  Synthetic Luk278 HlgC, LukS binding FN3 domain
LPAPKNLVVSRVTEDSARLSWTAPDAAFDSFPIFYWEFAVSGEAIVLTVPGSERSYDLTGLKPGTEYSVVIHGVKGGVISEPLSAIFTT

SEQ ID NO: 269 - protein, 89 aa, Artificial
  Synthetic Luk279 HlgC, LukS binding FN3 domain
LPAPKNLVVSRVTEDSARLSWTAPDAAFDSFQIIYFEFFIGGEAIVLTVPGSERSYDLTGLKPGTEYFVVIHGVKGGDLSAPLSAIFTT

SEQ ID NO: 270 - protein, 89 aa, Artificial
  Synthetic Luk280 HlgC, LukS binding FN3 domain
LPAPKNLVVSRVTEDSARLSWTAPDAAFDSFSIIYWEFASNGEAIVLTVPGSERSYDLTGLKPGTEYFVAIYGVKGGEISNPLSAIFTT

SEQ ID NO: 271 - protein, 89 aa, Artificial
  Synthetic Luk281 HlgC, LukS binding FN3 domain
LPAPKNLVVSRVTEDSARLSWTAPDAAFDSFTIFYFEFQTHGEAIVLTVPGSERSYDLTGLKPGTEYFVPITGVKGGWYSDPLSAIFTT

SEQ ID NO: 272 - protein, 89 aa, Artificial
  Synthetic Luk282 HlgC binding FN3 domain
LPAPKNLVVSRVTEDSARLSWTAPDAAFDSFIIIYWEYRTCGEAIVLTVPGSERSYDLTGLKPGTEYFVEIYGVKGGNTSPPLSAIFTT

SEQ ID NO: 273 - protein, 89 aa, Artificial
  Synthetic Luk283 HlgC, LukS binding FN3 domain
LPAPKNLVVSRVTEDSARLSWTAPDAAFDSITIHYFEPHTGGEAIVLTVPGSERSYDLTGLKPGTEYFVPIYGVKGGYISQPLSAIFTT

SEQ ID NO: 274 - protein, 89 aa, Artificial
  Synthetic Luk285 HlgC, LukS binding FN3 domain
LPAPKNLVVSRVTEDSARLSWTAPDAAFDSFPILYWENITTGEAIVLTVPGSERSYDLTGLKPGTEYFVVIHGVKGGFISGPLSAIFTT

SEQ ID NO: 275 - protein, 89 aa, Artificial
  Synthetic Luk286 HlgC binding FN3 domain
LPAPKNLVVSRVTEDSARLSWTAPDAAFDSFPIFYWEFQAAGEAIVLTVPGSERSYDLTGLKPGTEYFVEIYGVKGGWTSFPLSAIFTT

SEQ ID NO: 276 - protein, 89 aa, Artificial
  Synthetic Luk287 HlgC binding FN3 domain
LPAPKNLVVSRVTEDSARLSWTAPDAAFDSFVIVYWEWQCNGEAIVLTVPGSERSYDLTGLKPGTEYFVFIHGVKGGITSAPLSAIFTT

SEQ ID NO: 277 - protein, 89 aa, Artificial
  Synthetic Luk288 HlgC binding FN3 domain
LPAPKNLVVSRVTEDSARLSWTAPDAAFDSFAIHYWEPQGIGEAIVLTVPGSERSYDLTGLKPGTEYFVGIHGVKGGWISFPLSAIFTT

SEQ ID NO: 278 - protein, 89 aa, Artificial
  Synthetic Luk289 HlgC binding FN3 domain
LPAPKNLVVSRVTEDSARLSWTAPDAAFDSFIIPYWEYQYAGEAIVLTVPGSERSYDLTGLKPGTEYWVGIYGVKGGSISEPLSAIFTT

SEQ ID NO: 279 - protein, 89 aa, Artificial
  Synthetic Luk290 HlgC, LukS binding FN3 domain
LPAPKNLVVSRVTEDSARLSWTAPDAAFDSFTIFYIEPQFEGEAIVLTVPGSERSYDLTGLKPGTEYIVVIHGVKGGYISKPLSAIFTT

SEQ ID NO: 280 - protein, 89 aa, Artificial
  Synthetic Luk291 HlgC, LukS binding FN3 domain
LPAPKNLVVSRVTEDSARLSWTAPDAAFDSFNIIYWEYDPHGEAIVLTVPGSERSYDLTGLKPGTEYIVSIYGVKGGYISPPLSAIFTT

SEQ ID NO: 281 - protein, 89 aa, Artificial
  Synthetic Luk292 HlgC binding FN3 domain
LPAPKNLVVSRVTEDSARLSWTAPDAAFDSFAIEYWEWIDKGEAIVLTVPGSERSYDLTGLKPGTEYFVGIYGVKGGYISWPLSAIFTT

SEQ ID NO: 282 - protein, 89 aa, Artificial
  Synthetic Luk293 HlgC, LukS, LukD, LukAB binding FN3 domain
LPAPKNLVVSRVTEDSARLSWTAPDAAFDSFSILYHEWSGWGEAIVLTVPGSERSYDLTGLKPGTEYFVFIHGVKGGYISPPLSAIFTT

SEQ ID NO: 283 - protein, 89 aa, Artificial
  Synthetic Luk294 HlgC, LukS binding FN3 domain
LPAPKNLVVSRVTEDSARLSWTAPDAAFDSFQILYWETAKSGEAIVLTVPGSERSYDLTGLKPGTEYFVEIYGVKGGWISWPLSAIFTT

SEQ ID NO: 284 - protein, 89 aa, Artificial
  Synthetic Luk296 HlgC binding FN3 domain
LPAPKNLVVSRVTEDSARLSWTAPDAAFDSFTIHYYEFKYQGEAIVLTVPGSERSYDLTGLKPGTEYFVVIHGVKGGFISPPLSAIFTT

SEQ ID NO: 285 - protein, 89 aa, Artificial
  Synthetic Luk298 HlgC, LukS binding FN3 domain
LPAPKNLVVSRVTEDSARLSWTAPDAAFDSFTIIYLEGNWSGEAIVLTVPGSERSYDLTGLKPGTEYFVSIYGVKGGFISEPLSAIFTT

SEQ ID NO: 286 - protein, 89 aa, Artificial
  Synthetic Luk299 HlgC, LukS, LukAB binding FN3 domain
LPAPKNLVVSRVTEDSARLSWTAPDAAFDSFKIFYWEWPHSGEAIVLTVPGSERSYDLTGLKPGTEYFVAIHGVKGGWISKPLSAIFTT

SEQ ID NO: 287 - protein, 89 aa, Artificial
  Synthetic Luk300 HlgC binding FN3 domain
LPAPKNLVVSRVTEDSARLSWTAPDAAFDSFTISYWEYAGYGEAIVLTVPGSERSYDLTGLKPGTEYFVGIHGVKGGWISKPLSAIFTT

SEQ ID NO: 288 - protein, 89 aa, Artificial
  Synthetic Luk301 HlgC binding FN3 domain
LPAPKNLVVSRVTEDSARLSWTAPDAAFDSFHISYWEYYARGEAIVLTVPGSERSYDLTGLKPGTEYFVGIYGVKGGVISPPLSAIFTT

SEQ ID NO: 289 - protein, 89 aa, Artificial
  Synthetic Luk302 HlgC, LukS binding FN3 domain
LPAPKNLVVSRVTEDSARLSWTAPDAAFDSFKIWYLETGFRGEAIVLTVPGSERSYDLTGLKPGTEYFVPIYGVKGGYISQPLSAIFTT

SEQ ID NO: 290 - protein, 89 aa, Artificial
  Synthetic Luk303 HlgC binding FN3 domain
LPAPKNLVVSRVTEDSARLSWTAPDAAFDSFNIQYWEWNLGGEAIVLTVPGSERSYDLTGLKPGTEYFVAIYGVKGGAISDPLSAIFTT

SEQ ID NO: 291 - protein, 89 aa, Artificial
  Synthetic Luk304 HlgC binding FN3 domain
LPAPKNLVVSRVTEDSARLSWTAPDAAFDSFWIGYTELYEFGEAISLLVPGSERSYDLTGLKPGTEYSVAIAGVKGGAYSHPLHALFTT

SEQ ID NO: 292 - protein, 89 aa, Artificial
  Synthetic Luk305 HlgC binding FN3 domain
LPAPKNLVVSRVTEDSARLSWTAPDAAFDSFYIKYAEHVVWGEAIDLLVPGSERSYDLTGLKPGTEYEVGIAGVKGGTVSVPLSARFTT

SEQ ID NO: 293 - protein, 89 aa, Artificial
  Synthetic Luk306 HlgC, LukS binding FN3 domain
LPAPKNLVVSRVTEDSARLSWTAPDAAFDSFIILYDEIWPSGEAISLGVPGSERSYDLTGLKPGTEYFVAIHGVKGGNISDPLDAKFTT

SEQ ID NO: 294 - protein, 89 aa, Artificial
  Synthetic Luk307 HlgC, LukS binding FN3 domain
LPAPKNLVVSRVTEDSARLSWTAPDAAFDSFWIGYTESRYYGEAIDLLVPGSERSYDLTGLKPGTEYHVRISGVKGGAFSTPLWAAATT

SEQ ID NO: 295 - protein, 89 aa, Artificial
  Synthetic Luk308 HlgC binding FN3 domain
LPAPKNLVVSRVTEDSARLSWTAPDAAFDSFWIGYGERLRFGEAIDLLVPGSERSYDLTGLKPGTEYHVGISGVKGGWFSNPLRAIFTT

SEQ ID NO: 296 - protein, 89 aa, Artificial
  Synthetic Luk309 HlgC binding FN3 domain
LPAPKNLVVSRVTEDSARLSWTAPDAAFDSFKIFYLESDWEGEAIALWVPGSERSYDLTGLKPGTEYFVFIHGVKGGYISIPLHANFTT

SEQ ID NO: 297 - protein, 89 aa, Artificial
  Synthetic Luk310 HlgC, LukS binding FN3 domain
LPAPKNLVVSRVTEDSARLSWTAPDAAFDSFWIGYTETAKWGEAITLLVPGSERSYDLTGLKPGTEYRVGIGGVKGGGWSWPLDAIFTT

SEQ ID NO: 298 - protein, 88 aa, Artificial
  Synthetic Luk311 HlgC binding FN3 domain
LPAPKNLVVSRVTEDSARLSWTAPDAAFDSFWISYVEPDDGEAIELLVPGSERSYDLTGLKPGTEYIVQIDGVKGGTTSVPLNARFTT

SEQ ID NO: 299 - protein, 89 aa, Artificial
  Synthetic Luk312 HlgC binding FN3 domain
LPAPKNLVVSRVTEDSARLSWTAPDAAFDSFWIGYSEYPEYGEAIDLVVPGSERSYDLTGLKPGTEYRVGITGVKGGWISKPLNATFTT

SEQ ID NO: 300 - protein, 89 aa, Artificial
  Synthetic Luk313 HlgC, LukS binding FN3 domain
LPAPKNLVVSRVTEDSARLSWTAPDAAFDSFWIGYNEIGKWGEAIDLIVPGSERSYDLTGLKPGTEYAVGIDGVKGGSISEPLPASFTT

SEQ ID NO: 301 - protein, 89 aa, Artificial
  Synthetic Luk314 HlgC binding FN3 domain
LPAPKNLVVSRVTEDSARLSWTAPDAAFDSFAIFYTEFNFKGEAIPLDVPGSERSYDLTGLKPGTEYFVSIHGVKGGEISPPLEALFTT

SEQ ID NO: 302 - protein, 89 aa, Artificial
  Synthetic Luk315 HlgC binding FN3 domain
LPAPKNLVVSRVTEDSARLSWTAPDAAFDSFWISYQEPDEIGEAIELIVPGSERSYDLTGLKPGTEYFVQIDGVKGGTWSIPLNAYFTT

SEQ ID NO: 303 - protein, 88 aa, Artificial
  Synthetic Luk317 HlgC, LukS binding FN3 domain
LPAPKNLVVSRVTEDSARLSWTAPDAAFDSFWIGYHEFPTWGEAIDLLVPGSERSYDLTGLKPGTEYQVRISGVKGGTTSQPLQAAAT

SEQ ID NO: 304 - protein, 89 aa, Artificial
  Synthetic Luk318 HlgC, LukS, HlgA binding FN3 domain
LPAPKNLVVSRVTEDSARLSWTAPDAAFDSFWIGYHETVGFGEAIALLVPGSERSYDLTGLKPGTEYAVAIDGVKGGWFSHPLVAYFTT

SEQ ID NO: 305 - protein, 89 aa, Artificial
  Synthetic Luk319 HlgC, LukS binding FN3 domain
LPAPKNLVVSRVTEDSARLSWTAPDAAFDSFWIGYFERFNWGEAIDLLVPGSERSYDLTGLKPGTEYQVQIDGVKGGDISIPLSARFTT

SEQ ID NO: 306 - protein, 89 aa, Artificial
  Synthetic Luk320 HlgC, LukS binding FN3 domain
LPAPKNLVVSRVTEDSARLSWTAPDAAFDSFWIGYSEWEQLGEAIDLIVPGSERSYDLTGLKPGTEYQVGIAGVKGGSSSFPLGAEFTT

SEQ ID NO: 307 - protein, 89 aa, Artificial
  Synthetic Luk321 HlgC binding FN3 domain
LPAPKNLVVSRVTEDSARLSWTAPDAAFDSFWIGYQEAATWGEAIDLSVPGSERSYDLTGLKPGTEYHVGIVGVKGGGVSTPLVAPFTT

SEQ ID NO: 308 - protein, 89 aa, Artificial
  Synthetic Luk322 HlgC, LukS binding FN3 domain
LPAPKNLVVSRVTEDSARLSWTAPDAAFDSFWIGYYESHRGGEAIDLLVPGSERSYDLTGLKPGTEYTVGITGVKGGTISYPLHAIFTT

SEQ ID NO: 309 - protein, 89 aa, Artificial
  Synthetic Luk323 HlgC binding FN3 domain
LPAPKNLVVSRVTEDSARLSWTEPDAAFDSFWIAYPEPGFQGEAISLLVPGSERSYDLTGLKPGTEYEVQIAGVKGGHVSWPLVATFTT

SEQ ID NO: 310 - protein, 89 aa, Artificial
  Synthetic Luk324 HlgC, LukS binding FN3 domain
LPAPKNLVVSRVTEDSARLSWTAPDAAFDSFWIAYEEVRAEGEAIELLVPGSERSYDLTGLKPGTEYVVGIDGVKGGGFSSPLVAHFTT

SEQ ID NO: 311 - protein, 89 aa, Artificial
  Synthetic Luk326 HlgC binding FN3 domain
LPAPKNLVVSRVTEDSARLSWTAPDAAFDSFWIAYYERTQQGEAIELLVPGSERSYDLTGLKPGTEYWVGIDGVKGGEVSQPLKAHFTT

SEQ ID NO: 312 - protein, 89 aa, Artificial
  Synthetic Luk327 HlgC binding FN3 domain
LPAPKNLVVSRVTEDSARLSWTAPDAAFDSFAIFYLEWLYHGEAIKLYVPGSERSYDLTGLKPGTEYYVVIHGVKGGFVSTPLFATFTT

SEQ ID NO: 313 - protein, 89 aa, Artificial
  Synthetic Luk329 HlgC, LukF binding FN3 domain
LPAPKNLVVSRVTEDSARLSWTAPDAAFDSFWIGYWEGIGYGEAITLLVPGSERSYDLTGLKPGTEYNVGIDGVKGGDFSTPLWARFTT

SEQ ID NO: 314 - protein, 89 aa, Artificial
  Synthetic Luk330 HlgC, LukS binding FN3 domain
LPAPKNLVVSRVTEDSARLSWTAPDAAFDSFWIGYHEFSTYGEAIDLLVPGSERSYDLTGLKPGTEYTVKIAGVKGGATSVPLVATFTT

SEQ ID NO: 315 - protein, 89 aa, Artificial
  Synthetic Luk331 HlgC, LukS, LukD binding FN3 domain
LPAPKNLVVSRVTEDSARLSWTAPDAAFDSFAIFYFEDDERGEAIVLNVPGSERSYDLTGLKPGTEYHVIIHGVKGGQISSPLYATFTT

SEQ ID NO: 316 - protein, 89 aa, Artificial
  Synthetic Luk332 HlgC, LukS, LukAB binding FN3 domain
LPAPKNLVVSRVTEDSARLSWTAPDAAFDSFWIAYGEWEYPGEAIELLVPGSERSYDLTGLKPGTEYHVGIDGVKGGRVSYPLRAQFTT

SEQ ID NO: 317 - protein, 89 aa, Artificial
  Synthetic Luk333 HlgC binding FN3 domain
LPAPKNLVVSRVTEDSARLSWTAPDAAFDSFRIHYWEGLFVGEAIVLSVPGSERSYDLTGLKPGTEYAVPIYGVKGGSISKPLYALFTT

SEQ ID NO: 318 - protein, 89 aa, Artificial
  Synthetic Luk334 HlgC binding FN3 domain
LPAPKNLVVSRVTEDSARLSWTAPDAAFDSFHIGYHEAEGFGEAIALLVPGSERSYDLTGLKPGTEYPVGISGVKGGFVSFPLWARFTT

SEQ ID NO: 319 - protein, 89 aa, Artificial
  Synthetic Luk335 HlgC, LukS binding FN3 domain
LPAPKNLVVSRVTEDSARLSWTAPDAAFDSFWIGYNEIVNHGEAIDLVVPGSERSYDLTGLKPGTEYRVSIGGVKGGHWSVPLWARFTT

SEQ ID NO: 320 - protein, 89 aa, Artificial
  Synthetic Luk336 HlgC, LukS binding FN3 domain
LPAPKNLVVSRVTEDSARLSWTAPDAAFDSFWIGYHEWIGPGEAISLLVPGSERSYDLTGLKPGTEYWVGIAGVKGGWSSRPLSATFTT

SEQ ID NO: 321 - protein, 89 aa, Artificial
  Synthetic Luk337 HlgC, LukS binding FN3 domain
LPAPKNLVVSRVTEDSARLSWTAPDAAFDSFWIGYEEPLYFGEAIDLLVPGSERSYDLTGLKPGTEYRVHIGGVKGGRVSIPLEAEFTT

SEQ ID NO: 322 - protein, 89 aa, Artificial
  Synthetic Luk338 HlgC, LukS binding FN3 domain
LPAPKNLVVSRVTEDSARLSWTAPDAAFDSFWIAYEEDNAQGEAIELLVPGSERSYDLTGLKPGTEYDVKIDGVKGGRVSTPLVARFTT

SEQ ID NO: 323 - protein, 89 aa, Artificial
  Synthetic Luk339 HlgC binding FN3 domain
LPAPKNLVVSRVTEDSARLSWTAPDAAFDSFVIFYWEGQWNGEAILLDVPGSERSYDLTGLKPGTEYIVPIHGVKGGWISLPLVATFTT

SEQ ID NO: 324 - protein, 89 aa, Artificial
  Synthetic Luk340 HlgC, LukS binding FN3 domain
LPAPKNLVVSRVTEDSARLSWTAPDAAFDSFWIGYHESPYAGEAIDLVVPGSERSYDLTGLKPGTEYAVGIAGVKGGGYSIPLRAIFTT

SEQ ID NO: 325 - protein, 89 aa, Artificial
  Synthetic Luk342 HlgC, LukS binding FN3 domain
LPAPKNLVVSRVTEDSARLSWTAPDAAFDSFWIGYSEPTIYGEAIDLLVPGSERSYDLTGLKPGTEYFVGITGVKGGWNSRPLSAIFTT

SEQ ID NO: 326 - protein, 89 aa, Artificial
  Synthetic Luk343 HlgC binding FN3 domain
LPAPKNLVVSRVTEDSARLSWTAPDAAFDSFAIFYTETHWFGEAINLPVPGSERSYDLTGLKPGTEYGVIIHGVKGGYISDPLWAAFTT

SEQ ID NO: 327 - protein, 89 aa, Artificial
  Synthetic Luk344 HlgC, LukS binding FN3 domain
LPAPKNLVVSRVTEDSARLSWTAPDAAFDSFWISYVEPVFSGEAIELLVPGSERSYDLTGLKPGTEYIVGIGGVKGGGWSIPLEAHFTT

SEQ ID NO: 328 - protein, 89 aa, Artificial
  Synthetic Luk345 HlgC binding FN3 domain
LPAPKNLVVSRVTEDSARLSWTAPDAAFDSFSIFYIEAKFRGEAIRLGVPGSERSYDLTGLKPGTEYFVWIHGVKGGEISDPLEAPFTT

SEQ ID NO: 329 - protein, 89 aa, Artificial
  Synthetic Luk346 HlgC, LukS binding FN3 domain
LPAPKNLVVSRVTEDSARLSWTAPDAAFDSFWIAYYEIVGWGEAITLLVPGSERSYDLTGLKPGTKYVVLIDGVKGGLLSQPLHAEFAT

SEQ ID NO: 330 - protein, 89 aa, Artificial
  Synthetic Luk347 HlgC, LukS binding FN3 domain
LPAPKNLVVSRVTEDSARLSWTAPDAAFDSFWIGYHETTRFGEAIDLLVPGSERSYDLTGLKPGTEYVVAIQGVKGGHVSQPLRAPFTT

SEQ ID NO: 331 - protein, 89 aa, Artificial
  Synthetic Luk348 HlgC binding FN3 domain
LPAPKNLVVSRVTEDSARLSWTAPDAAFDSFSIIYLEASFRGEAIVLTVPGSERSYDLTGLKPGTEYFVSIYGVKGGHFSPPLDAIFTT

SEQ ID NO: 332 - protein, 89 aa, Artificial
  Synthetic Luk349 HlgC binding FN3 domain
LPAPKNLVVSRVTEDSARLSWTAPDAAFDSFWIGYREWIQWGEAISLLVPGSERSYDLTGLKPGTEYRVGITGVNGGVTSVPLHAKFTT

SEQ ID NO: 333 - protein, 89 aa, Artificial
  Synthetic Luk350 HlgC, LukF binding FN3 domain
LPAPKNLVVSRVTEDSARLSWTAPDAAFDSFWIAYHEGLSWGEAIDLLVPGSERSYDLTGLKPGTEYTVSIDGVKGGYTSEPLRASFTT

SEQ ID NO: 334 - protein, 89 aa, Artificial
  Synthetic Luk351 HlgC, LukS binding FN3 domain
LPAPKNLVVSRVTEDSARLSWTAPDAAFDSFWIGYDETLTYGEAITLLVPGSERSYDLTGLKPGTEYTVGIDGVKGGRNSVPLKATFTT

SEQ ID NO: 335 - protein, 89 aa, Artificial
  Synthetic Luk353 HlgC, LukS binding FN3 domain
LPAPKNLVVSRVTEDSARLSWTAPDAAFDSFWIGYHEPRAWGEAIDLLVPGSERSYDLTGLKPGTEYLVGIGGVKGGKQSKPLVAKFTT

SEQ ID NO: 336 - protein, 89 aa, Artificial
  Synthetic Luk354 HlgC, LukS binding FN3 domain
LPAPKNLVVSRVTEDSARLSWTAPDAAFDSFWIGYTEQKNHGEAIDLLVPGSERSYDLTGLKPGTEYEVNIAGVKGGGWSIPLNAWFTT

SEQ ID NO: 337 - protein, 89 aa, Artificial
  Synthetic Luk355 HlgC binding FN3 domain
LPAPKNLVVSRVTEDSARLSWTAPDAAFDSFKIVYVEIHYRGEAIHLSVPGSERSYDLTGLKPGTEYHVVIHGVKGGGISLPLDAPFTT

SEQ ID NO: 338 - protein, 89 aa, Artificial
  Synthetic Luk356 HlgC, LukS binding FN3 domain
LPAPKNLVVSRVTEDSARLSWTAPDATFDSFWIGYSEDQRTGEAIDLVVPGSERSYDLTGLKPGTEYRVAIAGVKGGYISQPLSANFTT

SEQ ID NO: 339 - protein, 89 aa, Artificial
  Synthetic Luk357 HlgC binding FN3 domain
LPAPKNLVVSRVTEDSARLSWTAPDAAFDSFTIHYFESLLTGEAISLVVPGSERSYDLTGLKPGTEYLVPIYGVKGGFISQPLIAIFTT

SEQ ID NO: 340 - protein, 89 aa, Artificial
  Synthetic Luk358 HlgC, LukS binding FN3 domain
LPAPKNLVVSRVTEDSARLSWTAPDAAFDSFAINYYEYYPAGEAIVLTVPGSERSYDLTGLKPGTEYFVAIYGVKGGYISPPLSAIFTT

SEQ ID NO: 341 - protein, 89 aa, Artificial
  Synthetic Luk361 HlgC binding FN3 domain
LPAPKNLVVSRVTEDSARLSWTAPDAAFDSFSIYYYEYYANGEAIVLTVPGSERSYDLTGLKPGTEYFVAIYGVKGGYVSDPLSAIFTT

SEQ ID NO: 342 - protein, 89 aa, Artificial
  Synthetic Luk362 HlgC binding FN3 domain
LPAPKNLVVSRVTEDSARLSWTAPDAAFDSFPIYYLEYSFTGEAIVLTVPGSERSYDLTGLKPGTEYAVYIYGVKGGWISDPLSAIFTT

SEQ ID NO: 343 - protein, 89 aa, Artificial
  Synthetic Luk363 HlgC binding FN3 domain
LPAPKNLVVSRVTEDSARLSWTAPDAAFDSFRIYYYEWASYGEAIVLTVPGSERSYDLTGLKPGTEYFVGIYGVKGGHISRPLSAIFTT

SEQ ID NO: 344 - protein, 89 aa, Artificial
  Synthetic Luk364 HlgC binding FN3 domain
LPAPKNLVVSRVTEDSARLSWTAPDAAFDSFRIFYHEYSYRGEAIVLTVPGSERSYDLTGLKPGTEYLVIIHSVKGGSVSSPLSAIFTT

SEQ ID NO: 345 - protein, 89 aa, Artificial
  Synthetic Luk365 HlgC, LukS binding FN3 domain
LPAPKNLVVSRVTEDSARLSWTAPDAAFDSFTIYYYEYWYGGEAIVLTVPGSERSYDLTGLKPGTEYWVGIYGVKGGYISSPLSAIFTT

SEQ ID NO: 346 - protein, 89 aa, Artificial
  Synthetic Luk366 HlgC, LukS binding FN3 domain
LPAPKNLVVSRVTEDSARLSWTAPDAAFDSFAIFYYEFNWGGEAIVLTVPGSERSYDLTGLKPGTEYWVGIYGVKGGYISYPLSAIFTT

SEQ ID NO: 347 - protein, 89 aa, Artificial
  Synthetic Luk368 HlgC binding FN3 domain
LPAPKNLVVSRVTEDSARLSWTAPDAAFDSFAIYYFESINLGDAIVLTVPGSERSYDLTGLKPGTEYYVYIYGVKGGYISYPLSAIFTT

SEQ ID NO: 348 - protein, 89 aa, Artificial
  Synthetic Luk369 HlgC binding FN3 domain
LPAPKNLVVSRVTEDSARLSWTAPDAAFDSFRIFYYEYGGGGEAIVLTVPGSERSYDLTGLKPGTEYHVGIYGVKGGYISPPLSAIFTT

SEQ ID NO: 349 - protein, 89 aa, Artificial
  Synthetic Luk370 HlgC binding FN3 domain
LPAPKNLVVSRVTEDSARLSWTAPDAAFDSFSIYYFEYWTYGEAIVLTVPGSERSYDLTGLKPGTEYYVYIYGVKGGYISDPLSAIFTT

SEQ ID NO: 350 - protein, 88 aa, Artificial
  Synthetic Luk371 HlgC binding FN3 domain
LPAPKNLVVSRVIEDSARLSWTAPDAAFDSFTIFYYEYDSGEAIVLTVPGSERSYDLTGLKPGTEYTVAIFGVKGGYISAPLSAIFTT

SEQ ID NO: 351 - protein, 89 aa, Artificial
  Synthetic Luk372 HlgC, LukS binding FN3 domain
LPAPKNLVVSRVTEDSARLSWTAPDAAFDSFLIGYEEYANAGEAIVLTVPGSERSYDLTGLKPGTEYLVFIYGVKGGYYSYPLSAIFTT

SEQ ID NO: 352 - protein, 89 aa, Artificial
  Synthetic Luk373 HlgC binding FN3 domain
LPAPKNLVVSRVTEDSARLSWTAPDAAFDSFHIYYFEYINLGEAIVLTVPGSERSYDLTGLKPGTEYFVYIHGVKGGFVSDPLSAIFTT

SEQ ID NO: 353 - protein, 89 aa, Artificial
  Synthetic Luk374 HlgC binding FN3 domain
LPAPKNLVVSRVTEDSARLSWTAPDAAFDSFVIEYWEYRLAGEAIVLTVPGSERSYDLTGLKPGTEYFVGIYGVKGGAVSLPLSAIFTT

SEQ ID NO: 354 - protein, 89 aa, Artificial
  Synthetic Luk375 HlgC binding FN3 domain
LPAPKNLVVSRVTEDSARLSWTAPDAAFDSFHIDYWEYVFLGEAIVLTVPGSERSYDLTGLKPGTEYFVSITGVKGGRYSYPLSAIFTT

SEQ ID NO: 355 - protein, 89 aa, Artificial
  Synthetic Luk376 HlgC, LukS binding FN3 domain
LPAPKNLVVSRVTEDSARLSWTAPDAAFDSFTIPYYEYWWSGEAIVLTVPGSERSYDLTGLKPGTEYWVGIYGVKGGYISSPLSAIFTT

SEQ ID NO: 356 - protein, 89 aa, Artificial
  Synthetic Luk377 HlgC binding FN3 domain
LPAPKNLVVSRVTEDSARLSWTAPDAAFDSFWINYWEYYPHGEAIVLTVPGSERSYDLTGLKPGTEYFVGIYGVKGGSYSHPLSAIFTT

SEQ ID NO: 357 - protein, 89 aa, Artificial
  Synthetic Luk378 HlgC, LukS binding FN3 domain
LPAPKNLVVSRVTEDSARLSWTAPDAAFDSFAIFYHEDAYTGEAIVLTVPGSERSYDLTGLKPGTEYFVVIHGVKGGFLSRPLSAIFTT

SEQ ID NO: 358 - protein, 89 aa, Artificial
  Synthetic Luk379 HlgC binding FN3 domain
LPAPKNLVVSRVTEDSARLSWTAPDAAFDSFYILYHEYEYSGEAIVLTVPGSERSYDLTGLKPGTEYFVAIYGVKGGLYSAPLSAIFTT

SEQ ID NO: 359 - protein, 85 aa, Artificial
  Synthetic Luk380 HlgC, LukS binding FN3 domain
LPAPKNLVVSRVNEDSARLSWTAPDAAFDSFDIVYGVGEAIVLTVPGSERSYDLTGLKPGTEYYVPIAGVKGGGVSWPLSAIFTT

SEQ ID NO: 360 - protein, 89 aa, Artificial
  Synthetic Luk381 HlgC, LukS binding FN3 domain
LPAPKNLVVSRVTEDSARLSWTAPDAAFDSFRIYYYEYYKYGEAIVLTVPGSERSYDLTGLKPGTEYFVAIYGVKGGEISDPLSAIFTT

SEQ ID NO: 361 - protein, 89 aa, Artificial
  Synthetic Luk382 HlgC binding FN3 domain
LPAPKNLVVSRVTEDSARLSWTAPDAAFDSFGIIYDETAQYGEAIVLTVPGSERSYDLTGLKPGTEYLVPIHGVKGGTISYPLSAIFTT

SEQ ID NO: 362 - protein, 94 aa, Artificial
  Synthetic Luk390 LukD binding FN3 domain
LPAPKNLVVSRVTEDSARLSWTYIHHGFDSFLIQYQESEKVGEAIVLTVPGSERSYDLTGLKPGTEYTVSIYGVVWGYWNPTQYSNPLSAIFTT

SEQ ID NO: 363 - protein, 94 aa, Artificial
  Synthetic Luk394 LukE binding FN3 domain
LPAPKNLVVSRVTEDSARLSWDQYRLNFDSFLIQYQESEKVGEAIVLTVPGSERSYDLTGLKPGTEYTVSIYGVNWGYFLAPEISNPLSAIFTT

SEQ ID NO: 364 - protein, 95 aa, Artificial
  Synthetic Luk399 LukE binding FN3 domain
LPAPKNLVVSRVTEDSARLSWPGQTRKFNIFDSFLIQYQESEKVGEAIVLTVPGSERSYDLTGLKPGTEYTVSIYGVVGIFLTFGSNPLSAIFTT

SEQ ID NO: 365 - protein, 93 aa, Artificial
  Synthetic Luk409 LukD binding FN3 domain
LPAPKNLVVSRVTEDSARLSWKYTLYQHYFDSFLIQYQESEKVGEAIVLTVPGSERSYDLTGLKPGTEYTVSIYGVLAWWSFGSNPLSAIFTT

SEQ ID NO: 366 - protein, 89 aa, Artificial
  Synthetic Luk412 LukE binding FN3 domain
LPAPKNLVVSRVTEDSARLSWTAPDAAFDSFGIGYLEYPWYGEAIVLTVPGSERSYDLTGLKPGTEYFVDIYGVKGGWWSYPLSAIFTT

SEQ ID NO: 367 - protein, 89 aa, Artificial
  Synthetic Luk414 LukE binding FN3 domain
LPAPNLLVVSRVTEDSARLSWTAPDAAFDSFWIDYIETYYYGEAIVLTVPGSERSYDLTGLKPGTEYLVDIYGVKGGWYSLPLSAIFTT

SEQ ID NO: 368 - protein, 89 aa, Artificial
  Synthetic Luk415 LukE binding FN3 domain
LPAPKNLVVSRVTEDSARLSWTAPDAAFDSFEISYTEYGISGEAIVLTVPGSERSYDLTGLKPGTEYFVDIYGVKGGYLSYPLSAIFTT

SEQ ID NO: 369 - protein, 89 aa, Artificial
  Synthetic Luk417 LukE binding FN3 domain
LPAPKNLVVSRVTEDSARLSWTAPDAAFDSFNIDYFEYYEFGEAIVLTVPGSERSYDLTGLKPGTEYFVDIYGVKGGSWSLPLSAIFTT

SEQ ID NO: 370 - protein, 94 aa, Artificial
  Synthetic Luk420 LukAB binding FN3 domain
LPAPKNLVVSRVTEDSARLSWWLGRFNFDSFLIQYQESEKVGEAIVLTVPGSERSYDLTGLKPGTEYTVSIYGVKQWIISEESLSNPLSAIFTT

SEQ ID NO: 371 - protein, 94 aa, Artificial
  Synthetic Luk428 LukF binding FN3 domain
LPAPKNLVVSRVTEDSARLSWGIKEETIIFDSFLIQYQESEKVGEAIVLTVPGSERSYDLTGLKPGTEYTVSIYGVNIIELHLWSNPLSAIFTT

SEQ ID NO: 372 - protein, 97 aa, Artificial
  Synthetic Luk438 HlgC binding FN3 domain
LPAPKNLVVSRVTEDSARLSWWRKPKRWRHFDSFLIQYQESEKVGEAIVLTVPGSERSYDLTGLKPGTEYTVSIYGVAPDTPTPVIISNPLSAIFTT

SEQ ID NO: 373 - protein, 97 aa, Artificial
  Synthetic Luk445 HlgA binding FN3 domain
LPAPKNLVVSRVTEDSARLSWEVNTKTSNKFDSFLIQYQESEKVGEAIVLTVPGSERSYDLTGLKPGTEYTVSIYGVGYWLTNVVLASNPLSAIFTT

SEQ ID NO: 374 - protein, 98 aa, Artificial
  Synthetic Luk447 LukD binding FN3 domain
LPAPKNLVVSRVTEDSARLSWGIDDYFVHFFDSFLIQYQESEKVGEAIVLTVPGSERSYDLTGLKPGTEYTVSIYGVSIHFEFTTYSRSNPLSAIFTT

SEQ ID NO: 375 - protein, 89 aa, Artificial
  Synthetic Luk449 LukE, HlgA binding FN3 domain
LPAPKNLVVSRVTEDSARLSWTAPDAAFDSFDISYDEYPEFGEAIVLTVPGSERSYDLTGLKPGTEYLVDIIGVKGGEISLPLSAIFTT

SEQ ID NO: 376 - protein, 89 aa, Artificial
  Synthetic Luk452 LukE, HlgA binding FN3 domain
LPAPKNLVVSRVTEDSARLSWTAPDAAFDSFNIHYAEYPDFGEAIVLTVPGSERSYDLTGLKPGTEYIVDIWGVKGGLGSWPLSAIFTT

SEQ ID NO: 377 - protein, 95 aa, Artificial
  Synthetic Luk460 LukF binding FN3 domain
LPAPKNLVVSRVTEDSARLSWIWGGESFDSFLIQYQESEKVGEAIVLTVPGSERSYDLTGLKPGTEYTVSIYGVGQIGFIYRPEGSNPLSAIFTT

SEQ ID NO: 378 - protein, 93 aa, Artificial
  Synthetic Luk461 LukF binding FN3 domain
LPAPKNLVVSRVTEDSARLSWLGPTATVFDSFLIQYQESEKVGEAIVLTVPGSERSYDLTGLKPGTEYTVSIYGVWSLLHHRFSNPLSAIFTT

SEQ ID NO: 379 - protein, 94 aa, Artificial
  Synthetic Luk462 LukF binding FN3 domain
LPAPKNLVVSRVTEDSARLSWHPIWVDFDSFLIQYQESEKVGEAIVLTVPGSERSYDLTGLKPGTEYTVSIYGVRGDGFEVILHSNPLSAIFTT

SEQ ID NO: 380 - protein, 96 aa, Artificial
  Synthetic Luk463 LukF binding FN3 domain
LPAPKNLVVSRVTEDSARLSWKWFKTTAFDSFLIQYQESEKVGEAIVLTVPGSERSYDLTGLKPGTEYTVSIYGVLHASEIHQWESSNPLSAIFTT

SEQ ID NO: 381 - protein, 95 aa, Artificial
  Synthetic Luk464 LukF binding FN3 domain
LPAPKNLVVSRVTEDSARLSWWWPVAPFDSFLIQYQESEKVGEAIVLTVPGSERSYDLTGLKPGTEYTVSIYGVGAINYVYFPTWSNPLSAIFTT

SEQ ID NO: 382 - protein, 93 aa, Artificial
  Synthetic Luk465 LukF binding FN3 domain
LPAPKNLVVSRVTEDSARLSWVTDPGTNFDSFLIQYQESEKVGEAIVLTVPGSERSYDLTGLKPGTEYTVSIYGVWSWVHSRYSNPLSAIFTT

SEQ ID NO: 383 - protein, 96 aa, Artificial
  Synthetic Luk467 LukF binding FN3 domain
LPAPKNLVVSRVTEDSARLSWPWLQYPFFDSFLIQYQESEKVGEAIVLTVPGSERSYDLTGLKPGTEYTVSIYGVGYLDWHIFQLASNPLSAIFTT

SEQ ID NO: 384 - protein, 99 aa, Artificial
  Synthetic Luk468 LukF binding FN3 domain
LPAPKNLVVSRVTEDSARLSWQPSHGEFANFDSFLIQYQESEKVGEAIVLTVPGSERSYDLTGLKPGTEYTVSIYGVQPWYRGGHIYDFSNPLSAIFTT

SEQ ID NO: 385 - protein, 97 aa, Artificial
  Synthetic Luk470 LukF binding FN3 domain
LPAPKNLVVSRVTEDSARLSWINYSDPDFFDSFLIQYQESEKVGEAIVLTVPGSERSYDLTGLKPGTEYTVSIYGVYHWWYRGTPVVSNPLSAIFTT

SEQ ID NO: 386 - protein, 97 aa, Artificial
  Synthetic Luk473 LukF, LukD, LukAB binding FN3 domain
LPAPKNLVVSRVTEDSARLSWLEGFFPQPLFDSFLIQYLESEKVGEAIVLTVPGSERSYDLTGLKPGTEYTVSIYGVPWYHHRWWFASNPLSAIFTT

SEQ ID NO: 387 - protein, 99 aa, Artificial
  Synthetic Luk475 LukF binding FN3 domain
LPAPKNLVVSRVTEDSARLSWKQHTNTHYQFDSFLIQYQESEKVGEAIVLTVPVSERSYDLTGLKPGTEYTVSIYGVRWIDNHLKFNVHSNPLSAIFTT

SEQ ID NO: 388 - protein, 97 aa, Artificial
  Synthetic Luk476 LukF, LukS, LukD, LukE, LukAB, HlgB, HlgC binding FN3 domain
LPAPKNLVVSRVTEDSARLSWLEGFFPQPLFDSFLIQYQESEKVGEAIVLTVPGSERSYDLTGLKPGTEYTVSIYGVPWYHHRWWFASNPLSAIFTT

SEQ ID NO: 389 - protein, 98 aa, Artificial
  Synthetic Luk478 HlgC binding FN3 domain
LPAPKNLVVSRVTEDSARLSWLEGFFPQPLFDSFLIQYQESEKVGEAIVLTVPGSERSYDLTGLKPGTEYTVSIYGVASRWHSFPVTTSNPLSAIFTT

SEQ ID NO: 390 - protein, 97 aa, Artificial
  Synthetic Luk479 LukF, LukD binding FN3 domain
LPAPKNLVVSRVTEDSARLSWLEGFFPQPLFDSFLIQYQESEKVGEAIVLTVPGSERSYGLTGLKPGTEYTVSIYGVPWYHHRWWFASNPLSAIFTT

SEQ ID NO: 391 - protein, 89 aa, Artificial
  Synthetic Luk483 LukF binding FN3 domain
LPAPKNLVVSRVTEDSARLSWTAPDAAFDSFRIFYYERFTWGEAIVLTVPGSERSYDLTGLKPGTEYPVHIWGVKGGIDSRPLSAIFTT

SEQ ID NO: 392 - protein, 89 aa, Artificial
  Synthetic Luk486 LukD, LukAB binding FN3 domain
LPAPKNLVVSRVTEDSARLSWTAPDAAFDSFAIRYGEETVHGEAIALIVPGSERSYDLTGLKPGTEYPVAIAGVKGGTWSIPLSAIFTT

SEQ ID NO: 393 - protein, 89 aa, Artificial
  Synthetic Luk487 LukF binding FN3 domain
LPAPKNLVVSRVTEDSARLSWTAPDAAFDSFAIHYLEFHYAGEAIVLTVPGSERSYDLTGLKPGTEYWVVIYGVKGDLISGPLSAIFTT

SEQ ID NO: 394 - protein, 94 aa, Artificial
  Synthetic Luk498 LukD binding FN3 domain
LPAPKNLVVSRVTEDSARLSWLPGPFRRFDSFLIQYQESEKVGEAIVLTVPGSERSYDLTGLKPGTEYTVSIYGVVNHEWYHAFSNPLSAIFTT

SEQ ID NO: 395 - protein, 94 aa, Artificial
  Synthetic Luk499 LukS binding FN3 domain
LPAPKNLVVSRVTEDSARLSWIGRELIWFDSFLIQYQESEKVGEAIVLTVPGSERSYDLTGLKPGTEYTVSIYGVVTHEWRSEFSNPLSAIFTT

SEQ ID NO: 396 - protein, 94 aa, Artificial
  Synthetic Luk500 LukS binding FN3 domain
LPAPKNLVVSRVTEDSARLSWKKPSYYIFDSFLIQYQESEKVGEAIVLTVPGSERSYDLTGLKPGTEYTVSIYGVVNHEWYHAFSNPLSAIFTT

SEQ ID NO: 397 - protein, 93 aa, Artificial
  Synthetic Luk505 LukS binding FN3 domain
LPAPKNLVVSRVTEDSARLSWQQAARWFDSFLIQYQESEKVGEAIVLTVPGSERSYDLTGLKPGTEYTVSIYGVVTREWFHSFSNPLSAIFTT

SEQ ID NO: 398 - protein, 94 aa, Artificial
  Synthetic Luk507 LukS binding FN3 domain
LPAPKNLVVSRVTEDSARLSWQHHGFRLFDSFLIQYQESEKVGEAIVLTVPGSERSYDLTGLKPGTEYTVSIYGVFTHEWFHEFSNPLSAIFTT

SEQ ID NO: 399 - protein, 96 aa, Artificial
  Synthetic Luk510 LukS binding FN3 domain
LPAPKNLVVSRVTEDSARLSWDEYSVTTWWFDSFLIQYQESEKVGEAIVLTVPGSERSYDLTGLKPGTEYTVSIYGVNELYRPWVASNPLSAIFTT

SEQ ID NO: 400 - protein, 97 aa, Artificial
  Synthetic Luk513 LukS binding FN3 domain
LPAPKNLVVSRVTEDSARLSWWTGGWRRNPFDSFLIQYQESEKVGEAIVLTVPGSERSYDLTGLKPGTEYTVSIYGVQLHRTIIAGESNPLSAIFTT

SEQ ID NO: 401 - protein, 95 aa, Artificial
  Synthetic Luk516 LukS binding FN3 domain
LPAPKNLVVSRVTEDSARLSWVGANSRHWFDSFLIQYQESEKVGEAIVLTVPGSERSYDLTGLKPGTEYTVSIYGVAVSEWFHSFSNPLSAIFTT

SEQ ID NO: 402 - protein, 96 aa, Artificial
  Synthetic Luk517 LukS binding FN3 domain
LPAPKNLVVSRVTEDSARLSWVNHLEGEAWFDSFLIQYQESEKVGEAIVLTVPGSERSYDLTGLKPGTEYTVSIYGVQTHEWWHKFSNPLSAIFTT

SEQ ID NO: 403 - protein, 97 aa, Artificial
  Synthetic Luk519 LukS binding FN3 domain
LPAPKNLVVSRVTEDSARLSWDLEHHNYHYFDSFLIQYQESEKVGEAIVLTVPGSERSYDLTGLKPGTEYTVSIYGVWFLQPAIHPPSNPLSAIFTT

SEQ ID NO: 404 - protein, 89 aa, Artificial
  Synthetic Luk520 HlgC, LukS binding FN3 domain
LPAPKNLVVSRVTEDSARLSWTAPDAAFDSFAIFYYEYWSNGEAIVLTVPGSERSYDLTGLKPGTEYWVGIHGVKGGLISHPLSAIFTT

SEQ ID NO: 405 - protein, 89 aa, Artificial
  Synthetic Luk521 HlgC, LukS binding FN3 domain
LPAPKNLVVSRVTEDSARLSWTAPDAAFDSFIITYEEATLNGEAIVLTVPGSERSYDLTGLKPGTEYTVGITGVKGGLGSYPLSAIFTT

SEQ ID NO: 406 - protein, 89 aa, Artificial
  Synthetic Luk522 HlgC, LukS binding FN3 domain
LPAPKNLVVSRVTEDSARLSWTAPDAAFDSFTIFYLEQRFQGEAIVLTVPGSERSYDLTGLKPGTEYAVIIHGVKGGWISFPLSAIFTT

SEQ ID NO: 407 - protein, 89 aa, Artificial
  Synthetic Luk523 HlgC, LukS binding FN3 domain
LPAPKNLVVSRVTEDSARLSWTAPDAAFDSFNIPYLERQLYGEAIVLTVPGSERSYDLTGLKPGTEYTVTIGGVKGGAPSRPLSAIFTT

SEQ ID NO: 408 - protein, 89 aa, Artificial
  Synthetic Luk524 HlgC, LukS binding FN3 domain
LPAPKNLVVSRVTEDSARLSWTAPDAAFDSFFIFYLEYAHPGEAIVLTVPGSERSYDLTGLKPGTEYHVIIHGVKGGLISEPLSAIFTT

SEQ ID NO: 409 - protein, 89 aa, Artificial
  Synthetic Luk525 HlgC, LukS binding FN3 domain
LPAPKNLVVSRVTEDSARLSWTAPDAAFDSFYIFYWESVTGGEAIVLTVPGSERSYDLTGLKPGTEYIVIIHGVKGGLISDPLSAIFTT

SEQ ID NO: 410 - protein, 89 aa, Artificial
  Synthetic Luk526 HlgC, LukS binding FN3 domain
LPAPKNLVVSRVTEDSARLSWTAPDAAFDSFPIFYDEHHQWGEAIVLTVPGSERSYDLTGLKPGTEYWVAIYGVKGGYYSSPLSAIFTT

SEQ ID NO: 411 - protein, 89 aa, Artificial
  Synthetic Luk527 HlgC, LukS binding FN3 domain
LPAPKNLVVSRVTEDSARLSWTAPDAAFDSFHIFYWEPNEVGEAIVLTVPGSERSYDLTGLKPGTEYFVEIYGVKGGEISYPLSAIFTT

SEQ ID NO: 412 - protein, 89 aa, Artificial
  Synthetic Luk528 HlgC, LukS binding FN3 domain
LPAPKNLVVSRVTEDSARLSWTAPDAAFDSFTIDYREETPKGEAIVLTVPGSERSYDLTGLKPGTEYWVIILGVKGGGDSFPLSAIFTT

SEQ ID NO: 413 - protein, 89 aa, Artificial
  Synthetic Luk529 LukS binding FN3 domain
LPAPKNLVVSRVTEDSARLSWTAPDAAFDSFGIYYGEWNPKGEAIVLTVPGSERSYDLTGLKPGTEYWVIISGVKGGPQSIPLSAIFTT

SEQ ID NO: 414 - protein, 89 aa, Artificial
  Synthetic Luk530 HlgC, LukD binding FN3 domain
LPAPKNLVVSRVTEDSARLSWTAPDAAFDSFGIFYHEIEENGEAIVLTVPGSERSYDLTGLKPGTEYFVAIHGVKGGVISTPLSAIFTT

SEQ ID NO: 415 - protein, 89 aa, Artificial
  Synthetic Luk531 HlgC, LukS binding FN3 domain
LPAPKNLVVSRVTEDSARLSWTAPDAAFDSFRIFYYELYHAGEAIVLTVPGSERSYDLTGLKPGTEYFVIIHGVKGGQISLPLSAIFTT

SEQ ID NO: 416 - protein, 89 aa, Artificial
  Synthetic Luk532 HlgC, LukS binding FN3 domain
LPAPKNLVVSRVTEDSARLSWTAPDAAFDSFTIFYLELESSGEAIVLTVPGSERSYDLTGLKPGTEYNVIIHGVKGGFISSPLSAIFTT

SEQ ID NO: 417 - protein, 89 aa, Artificial
  Synthetic Luk533 HlgC, LukS binding FN3 domain
LPAPKNLVVSRVTEDSARLSWTAPDAAFDSFPIFYVELRNPGEAIVLTVPGSERSYDLTGLKPGTEYHVVIHGVKGGFISHPLSAIFTT

SEQ ID NO: 418 - protein, 89 aa, Artificial
  Synthetic Luk534 HlgC, LukS binding FN3 domain
LPAPKNLVVSRVTEDSARLSWTAPDAAFDSFTIFYTEWNEFGEAIVLTVPGSERSYDLTGLKPGTEYFVIIHGVKGGQISVPLSAIFTT

SEQ ID NO: 419 - protein, 89 aa, Artificial
  Synthetic Luk535 HlgC, LukS binding FN3 domain
LPAPKNLVVSRVTEDSARLSWTAPDAAFDSFVIFYLEPTTQGEAIVLTVPGSERSYDLTGLKPGTEYFVIIHGVKGGPVSGPLSAIFTT

SEQ ID NO: 420 - protein, 89 aa, Artificial
  Synthetic Luk536 HlgC, LukS binding FN3 domain
LPAPKNLVVSRVTEDSARLSWTAPDAAFDSFWIAYIETDGWGEAIVLTVPGSERSYDLTGLKPGTEYFVPIHGVKGGYISQPLSAIFTT

SEQ ID NO: 421 - protein, 89 aa, Artificial
  Synthetic Luk537 HlgC, LukS binding FN3 domain
LPAPKNLVVSRVTEDSARLSWTAPDAAFDSFAIFYHEHKIRGEAIVLTVPGSERSYDLTGLKPGTEYLVIIHGVKGGYISLPLSAIFTT

SEQ ID NO: 422 - protein, 89 aa, Artificial
  Synthetic Luk538 HlgC, LukS binding FN3 domain
LPAPKNLVVSRVTEDSARLSWTAPDAAFDSFPIFYLERANRGEAIVLTVPGSERSYDLTGLKPGTEYFVIIHGVKGGTISDPLSAIFTT

SEQ ID NO: 423 - protein, 89 aa, Artificial
  Synthetic Luk539 HlgC, LukS binding FN3 domain
LPAPKNLVVSRVTEDSARLSWTAPDAAFDSFAIFYLETLYHGEAIVLTVPGSERSYDLTGLKPGTEYLVVIHGVKGGIISSPLSAIFTT

SEQ ID NO: 424 - protein, 89 aa, Artificial
  Synthetic Luk540 LukS binding FN3 domain
LPAPKNLVVSRVTEDSARLSWTAPDAAFDSFHIEYPEDTEQGEAIVLTVPGSERSYDLTGLKPGTEYNVHITGVKGGSKSAPLSAIFTT

SEQ ID NO: 425 - protein, 89 aa, Artificial
  Synthetic Luk541 LukS, LukD binding FN3 domain
LPAPKNLVVSRVTEDSARLSWTAPDAAFDSFNILYTETEQSGEAIVLTVPGSERSYDLTGLKPGTEYIVIIHGVKGGFISGPLSAIFTT

SEQ ID NO: 426 - protein, 89 aa, Artificial
  Synthetic Luk542 LukS binding FN3 domain
LPAPKNLVVSRVTEDSARLSWTAPDAAFDSFTIFYPEFRGDGEAIVLTVPGSERSYDLTGLKPGTEYGVIIHGVKGGGDSNPLSAIFTT

SEQ ID NO: 427 - protein, 89 aa, Artificial
  Synthetic Luk543 HlgC, LukS binding FN3 domain
LPAPKNLVVSRVTEDSARLSWTAPDAAFDSFAIFYTETFHYGEAIVLTVPGSERSYDLTGLKPGTEYLVVIHGVKGGDISAPLSAIFTT

SEQ ID NO: 428 - protein, 89 aa, Artificial
  Synthetic Luk544 HlgC, LukS binding FN3 domain
LPAPKNLVVSRVTEDSARLSWTAPDAAFDSFTIHYLEEFWLGEAIVLTVPGSERSYDLTGLKPGTEYFVAIYGVKGGFISVPLSAIFTT

SEQ ID NO: 429 - protein, 89 aa, Artificial
  Synthetic Luk545 HlgC, LukS binding FN3 domain
LPAPKNLVVSRVTEDSARLSWTAPDAAFDSFVIAYIEERWSGEAIVLTVPGSERSYDLTGLKPGTEYFVLIHGVKGGFISNPLSAIFTT

SEQ ID NO: 430 - protein, 89 aa, Artificial
  Synthetic Luk546 LukS binding FN3 domain
LPAPKNLVVSRVTEDSARLSWTAPDAAFDSFSIYYGEWPHGGEAIVLTVPGSERSYDLTSLKPGTEYFVLIIGVKGGQLSHPLSAIFTT

SEQ ID NO: 431 - protein, 89 aa, Artificial
  Synthetic Luk547 HlgC, LukS binding FN3 domain
LPAPKNLVVSRVTEDSARLSWTAPDAAFDSFTIFYLESSGTGEAIVLTVPGSERSYDLTGLKPGTEYLVIIHGVKGGRISNPLSAIFTT

SEQ ID NO: 432 - protein, 89 aa, Artificial
  Synthetic Luk548 HlgC, LukS, LukD binding FN3 domain
LPAPKNLVVSRVTEDSARLSWTAPDAAFDSFAIYYGEWHPDGEAIVLTVPGSERSYDLTGLKPGTEYWVFILGVKGGQNSQPLSAIFTT

SEQ ID NO: 433 - protein, 89 aa, Artificial
  Synthetic Luk549 HlgC, LukS binding FN3 domain
LPAPKNLVVSRVTEDSARLSWTAPDAAFDSFTIFYAESGNWGEAIVLTVPGSERSYDLTGLKPGTEYFVFIWGVKGGHESHPLSAIFTT

SEQ ID NO: 434 - protein, 89 aa, Artificial
  Synthetic Luk550 HlgC, LukS binding FN3 domain
LPAPKNLVVSRVTEDSARLSWTAPDAAFDSFAIFYAETDTKGEAIVLTVPGSERSYDLTGLKPGTEYLVIIHGVKGGSISVPLSAIFTT

SEQ ID NO: 435 - protein, 89 aa, Artificial
  Synthetic Luk551 HlgC, LukS binding FN3 domain
LPAPKNLVVSRVTEDSARLSWTAPDAAFDSFRIFYQEYSNHGEAIVLTVPGSERSYDLTGLKPGTEYFVPIYGVKGGFISRPLSAIFTT

SEQ ID NO: 436 - protein, 89 aa, Artificial
  Synthetic Luk552 HlgC, LukS binding FN3 domain
LPAPKNLVVSRVTEDSARLSWTAPDAAFDSFQIFYDENLWLGEAIVLTVPGSERSYDLTGLKPGTEYFVAIHGVKGGFISQPLSAIFTT

SEQ ID NO: 437 - protein, 89 aa, Artificial
  Synthetic Luk553 HlgC, LukS binding FN3 domain
LPAPKNLVVSRVTEDSARLSWTAPDAAFDSFHIFYAEHEKWGEAIVLTVPGSERSYDLTGLKPGTEYWVAIHGVKGGHISRPLSAIFTT

SEQ ID NO: 438 - protein, 89 aa, Artificial
  Synthetic Luk554 HlgC, LukS binding FN3 domain
LPAPKNLVVSRVTEDSARLSWTAPDAAFDSFSIFYLETFRRGEAIVLTVPGSERSYDLTGLKPGTEYLVIIHGVKGGYVSDPLSAIFTT

SEQ ID NO: 439 - protein, 89 aa, Artificial
  Synthetic Luk555 HlgC, LukS binding FN3 domain
LPAPKNLVVSRVTEDSARLSWTAPDAAFDSFSIFYPETNYQGEAIVLTVPGSERSYDLTGLKPGTEYLVVIHGVKGGYISDPLSAIFTT

SEQ ID NO: 440 - protein, 89 aa, Artificial
  Synthetic Luk556 HlgC, LukS binding FN3 domain
LPAPKNLVVSRVTEDSARLSWTAPDAAFDSFAIFYIEEETNGEAIVLTVPGSERSYDLTGLKPGTEYQVIIHGVKGGFISLPLSAIFTT

SEQ ID NO: 441 - protein, 89 aa, Artificial
  Synthetic Luk557 HlgC, LukS binding FN3 domain
LPAPKNLVVSRVTEDSARLSWTAPDAAFDSFVIFYPEVNFRGEAIVLTVPGSERSYDLTGLKPGTEYLVIIHGVKGGYISTPLSAIFTT

SEQ ID NO: 442 - protein, 89 aa, Artificial
  Synthetic Luk558 HlgC, LukS binding FN3 domain
LPAPKNLVVSRVTEDSARLSWTAPDAAFDSFAIFYHEWWKSGEAIVLTVPGSERSYDLTGLKPGTEYHVVIHGVKGGHISTPLSAIFTT

SEQ ID NO: 443 - protein, 89 aa, Artificial
  Synthetic Luk559 HlgC, LukS binding FN3 domain
LPAPKNLVVSRVTEDSARLSWTAPDAAFDSFTIHYPETRPTGEAIVLTVPGSERSYDLTGLKPGTEYFVVIYGVKGGWISPPLSAIFTT

SEQ ID NO: 444 - protein, 89 aa, Artificial
  Synthetic Luk560 HlgC, LukS binding FN3 domain
LPAPKNLVVSRVTEDSARLSWTAPDAAFDSFHIFYIEHVQVGEAIVLTVPGSERSYDLTGLKPGTEYFVIIHGVKGGIISPPLSAIFTT

SEQ ID NO: 445 - protein, 90 aa, Artificial
  Synthetic Luk561 HlgC, LukS binding FN3 domain
LPAPKNLVVSRVTEDSARLSWTAPDAAFDSFTIFYYPELYFHGEAIVLTVPGSERSYDLTGLKPGTEYLVVIHGVKGGFISPPLSAIFTT

SEQ ID NO: 446 - protein, 89 aa, Artificial
  Synthetic Luk562 LukS, LukAB binding FN3 domain
LPAPKNLVVSRVTEDSARLSWTAPDAAFDSFAIFYKEYTHGGEAIVLTVPGSERSYDLTGLKPGTEYWVIIHSVKGGSISYPLSAIFTT

SEQ ID NO: 447 - protein, 89 aa, Artificial
  Synthetic Luk563 HlgC, LukS binding FN3 domain
LPAPKNLVVSRVTEDSARLSWTAPDAAFDSFQIFYPEHYQDGEAIVLTVPGSERSYDLTGLKPGTEYLVVIHGVKGGWISSPLSAIFTT

SEQ ID NO: 448 - protein, 89 aa, Artificial
  Synthetic Luk564 HlgC, LukS binding FN3 domain
LPAPKNLVVSRVTEDSARLSWTAPDAAFDSFTIFYIEFRYPGEAIVLTVPGSERSYDLTGLKPGTEYFVAIHGVKGGYISDPLSAIFTT

SEQ ID NO: 449 - protein, 89 aa, Artificial
  Synthetic Luk565 HlgC, LukS binding FN3 domain
LPAPKNLVVSRVTEDSARLSWTAPDAAFDSFHIFYLETWGSGEAIVLTVPGSERSYDLTGLKPGTEYFVVIHGVKGGLISSPLSAIFTT

SEQ ID NO: 450 - protein, 89 aa, Artificial
  Synthetic Luk566 HlgC, LukS binding FN3 domain
LPAPKNLVVSRVTEDSARLSWTAPDAAFDSFAIFYYEHADAGEAIVLTVPGSERSYDLTGLKPGTEYFVIIHGVKGGYISKPLSAIFTT

SEQ ID NO: 451 - protein, 89 aa, Artificial
  Synthetic Luk567 HlgC, LukS binding FN3 domain
LPAPKNLVVSRVTEDSARLSWTAPDAAFDSFAIFYQEDSDHGEAIVLTVPGSERSYDLTGLKPGTEYFVAIHGVKGGTISKPLSAIFTT

SEQ ID NO: 452 - protein, 89 aa, Artificial
  Synthetic Luk568 HlgC, LukS binding FN3 domain
LPAPKNLVVSRVTEDSARLSWTAPDAAFDSFRIFYIEEHDVGEAIVLTVPGSERSYDLTGLKPGTEYIVIIHGVKGGYISDPLSAIFTT

SEQ ID NO: 453 - protein, 89 aa, Artificial
  Synthetic Luk569 HlgC, LukS binding FN3 domain
LPAPKNLVVSRVTEDSARLSWTAPDAAFDSFTILYPETQTIGEAIVLTVPGSERSYDLTGLKPGTEYFVGIHGVKGGIISDPLSAIFTT

SEQ ID NO: 454 - protein, 89 aa, Artificial
  Synthetic Luk570 LukS, LukD, LukAB binding FN3 domain
LPAPKNLVVSRVTEDSARLSWTAPDAAFDSFIIYYGEWREHGEAIVLTVPGSERSYDLTGLKPGTEYFVLIQGVKGGQTSGPLSAIFTT

SEQ ID NO: 455 - protein, 89 aa, Artificial
  Synthetic Luk571 HlgC, LukS binding FN3 domain
LPAPKNLVVSRVTEDSARLSWTAPDAAFDSFKIFYLEPKENGEAIVLTVPGSERSYDLTGLKPGTEYFVIITGVKGGFISEPLSAIFTT

SEQ ID NO: 456 - protein, 89 aa, Artificial
  Synthetic Luk572 LukS binding FN3 domain
LPAPKNLVVSRVTEDSARLSWTAPDAAFDSFLIHYDEWENGGEAIVLTVPGSERSYDLTGLKPGTEYWVIIIGVKGGVRSNPLSAIFTT

SEQ ID NO: 457 - protein, 89 aa, Artificial
  Synthetic Luk575 HlgC, LukS binding FN3 domain
LPAPKNLVVSRVTEDSARLSWTAPDAAFDSFPIFYVEIPQPGEAIVLTVPGSERSYDLTGLKPGTEYFVIIHGVKGGGISDPLSAIFTT

SEQ ID NO: 458 - protein, 89 aa, Artificial
  Synthetic Luk576 HlgC, LukS binding FN3 domain
LPAPKNLVVSRVTEDSARLSWTAPDAAFDSFVILYHEYWASGEAIVLTVPGSERSYDLTGLKPGTEYFVVIHGVKGGFLSDPLSAIFTT

SEQ ID NO: 459 - protein, 89 aa, Artificial
  Synthetic Luk577 HlgC, LukS binding FN3 domain
LPAPKNLVVSRVTEDSARLSWTAPDAAFDSFHIFYCEHWTSGEAIVLTVPGSERSYDLTGLKPGTEYFVAIHGVKGGEISAPLSAIFTT

SEQ ID NO: 460 - protein, 89 aa, Artificial
  Synthetic Luk578 HlgC, LukS binding FN3 domain
LPAPKNLVVSRVTEDSARLSWTAPDAAFDSFTIFYQEHLGYGEAIVLTVPGSERSYDLTGLKPGTEYVVVIHGVKGGWISSPLSAIFTT

SEQ ID NO: 461 - protein, 89 aa, Artificial
  Synthetic Luk579 HlgC, LukS binding FN3 domain
LPAPKNLVVSRVTEDSARLSWTAPDAAFDSFTIIYEETANGGEAIVLTVPGSERSYDLTGLKPGTEYFVVIHGVKGGHISSPLSAIFTT

SEQ ID NO: 462 - protein, 89 aa, Artificial
  Synthetic Luk580 HlgC, LukS, LukAB binding FN3 domain
LPAPKNLVVSRVTEDSARLSWTAPDAAFDSFQIFYPETQKYGEAIVLTVPGSERSYDLTGLKPGTEYFVVIHGVKGGFISSPLSAIFTT

SEQ ID NO: 463 - protein, 89 aa, Artificial
  Synthetic Luk581 HlgC, LukS binding FN3 domain
LPAPKNLVVSRVTEDSARLSWTAPDAAFDSFVIFYGEYENGGEAIVLTVPGSERSYDLTGLKPGTEYFVIIVGVKGGFDSKPLSAIFTT

SEQ ID NO: 464 - protein, 89 aa, Artificial
  Synthetic Luk582 HlgC, LukS binding FN3 domain
LPAPKNLVVSRVTEDSARLSWTAPDAAFDSFNIFYHETVDKGEAIVLTVPGSERSYDLTGLKPGTEYFVVVSGVKGGYISDPLSAIFTT

SEQ ID NO: 465 - protein, 89 aa, Artificial
  Synthetic Luk583 HlgC, LukS binding FN3 domain
LPAPKNLVVSRVTEDSARLSWTAPDAAFDSFQIFYREESKYGEAIVLTVPGSERSYDLTGLKPGTEYFVPIHGVKGGEISDPLSAIFTT

SEQ ID NO: 466 - protein, 89 aa, Artificial
  Synthetic Luk584 HlgC, LukS binding FN3 domain
LPAPKNLVVSRVTEDSARLSWTAPDAAFDSFQIFYQEVVEWGEAIVLTVPGSERSYDLTGLKPGTEYFVVIHGVKGGWISDPLSAIFTT

SEQ ID NO: 467 - protein, 89 aa, Artificial
  Synthetic Luk585 HlgC, LukS binding FN3 domain
LPAPKNLVVSRVTEDSARLSWTAPDAAFDSFTIFYPETWIAGEAIVLTVPGSERSYDLTGLKPGTEYLVVIHGVKGGIISWPLSAIFTT

SEQ ID NO: 468 - protein, 89 aa, Artificial
  Synthetic Luk587 HlgC, LukS binding FN3 domain
LPAPKNLVVSRVTEDSARLSWTAPDAAFDSFVIPYQEYLGWGEAIVLTVPGSERSYDLTGLKPGTEYWVGIYGVKGGFISPPLSAIFTT

SEQ ID NO: 469 - protein, 89 aa, Artificial
  Synthetic Luk588 HlgC, LukS binding FN3 domain
LPAPKNLVVSRVTEDSARLSWTAPDAAFDSFAIFYYEHQVAGEAIVLTVPGSERSYDLTGLKPGTEYFVAIHGVKGGWISSPLSAIFTT

SEQ ID NO: 470 - protein, 89 aa, Artificial
  Synthetic Luk589 HlgC, LukS binding FN3 domain
LPAPKNLVVSRVTEDSARLSWTAPDAAFDSFTIIYAEEQRNGEAIVLTVPGSERSYDLTGLKPGTEYFVIIHGVKGGFISPPLSAIFTT

SEQ ID NO: 471 - protein, 89 aa, Artificial
  Synthetic Luk590 HlgC, LukS binding FN3 domain
LPAPKNLVVSRVTEDSARLSWTAPDAAFDSFSIFYLEERLTGEAIVLTVPGSERSYDLTGLKPGTEYLVVIHGVKGGVISDPLSAIFTT

SEQ ID NO: 472 - protein, 89 aa, Artificial
  Synthetic Luk592 HlgC, LukS binding FN3 domain
LPAPKNLVVSRVTEDSARLSWTAPDAAFDSFTIFYYEAVHQGEAIVLTVPGSERSYDLTGLKPGTEYFVVIHGVKGGNISVPLSAIFTT

SEQ ID NO: 473 - protein, 89 aa, Artificial
  Synthetic Luk593 HlgC, LukS binding FN3 domain
LPAPKNLVVSRVTEDSARLSWTAPDAAFDSFAIFYVELVWKGEAIVLTVPGSERSYDLTGLKPGTEYFVVIHGVKGGYISDPLSAIFTT

SEQ ID NO: 474 - protein, 89 aa, Artificial
  Synthetic Luk594 HlgC, LukS binding FN3 domain
LPAPKNLVVSRVTEDSARLSWTAPDAAFDSFVIHYGEYENGGEAIVLTVPGSERSYDLTGLKPGTEYFVAIHGVKGGFISDPLSAIFTT

SEQ ID NO: 475 - protein, 89 aa, Artificial
  Synthetic Luk595 HlgC, LukS binding FN3 domain
LPAPKNLVVSRVTEDSARLSWTAPDAAFDSFTIIYFETKAYGEAIVLTVPGSERSYDLTGLKPGTEYWVIIHGVKGGYISVPLSAIFTT

SEQ ID NO: 476 - protein, 89 aa, Artificial
  Synthetic Luk596 HlgC, LukS binding FN3 domain
LPAPKNLVVSRVTEDSARLSWTAPDAAFDSFVIFYDEEWSKGEAIVLTVPGSERSYDLTGLKPGTEYAVFIYGVKGGAISEPLSAIFTT

SEQ ID NO: 477 - protein, 89 aa, Artificial
  Synthetic Luk597 HlgC, LukS binding FN3 domain
LPAPKNLVVSRVTEDSARLSWTAPDAAFDSFYIHYLETDPGGEAIVLTVPGSERSYDLTGLKPGTEYFVSIYGVKGGWISPPLSAIFTT

SEQ ID NO: 478 - protein, 89 aa, Artificial
  Synthetic Luk598 HlgC, LukS binding FN3 domain
LPAPKNLVVSRVTEDSARLSWTAPDAAFDSFVIFYDEDRPQGEAIVLTVPGSERSYDLTGLKPGTEYFVVIHGVKGGYLSIPLSAIFTT

SEQ ID NO: 479 - protein, 89 aa, Artificial
  Synthetic Luk599 HlgC, LukS binding FN3 domain
LPAPKNLVVSRVTEDSARLSWTAPDAAFDSFYIFYREETPHGEAIVLTVPGSERSYDLTGLKPGTEYWVLILGVKGGGISEPLSAIFTT

SEQ ID NO: 480 - protein, 89 aa, Artificial
  Synthetic Luk601 HlgC, LukS binding FN3 domain
LPAPKNLVVSRVTEDSARLSWTAPDAAFDSFTIFYIEDNKVGEAIVLTVPGSVRSYDLTGLKPGTEYFVVIHGVKGGIISEPLSAIFTT

SEQ ID NO: 481 - protein, 89 aa, Artificial
  Synthetic Luk602 HlgC, LukS binding FN3 domain
LPAPKNLVVSRVTEDSARLSWTAPDAAFDSFVIFYQELNRDGEAIVLTVPGSERSYDLTGLKPGTEYLVIIHGVKGGFISPPLSAIFTT

SEQ ID NO: 482 - protein, 89 aa, Artificial
  Synthetic Luk603 HlgC, LukS binding FN3 domain
LPAPKNLVVSRVTEDSARLSWTAPDAAFDSFHIFYLEFWYRGEAIVLTVPGSERSYDLTGLKPGTEYNVIIHGVKGGWISEPLSAIFTT

SEQ ID NO: 483 - protein, 89 aa, Artificial
  Synthetic Luk604 LukS binding FN3 domain
LPAPKNLVVSRVTEDSARLSWTAPDAAFDSFQIFYGEWPQEGEAIVLTVPGSERSYDLTGLKPGTEYWVVILGVKGGQASPPLSAIFTT

SEQ ID NO: 484 - protein, 89 aa, Artificial
  Synthetic Luk605 HlgC, LukS, LukD binding FN3 domain
LPAPKNLVVSRVTEDSARLSWTAPDAAFDSFRIHYLEHAARGEAIVLTVPGSERSYDLTGLKPGTEYFVAIYGVKGGYISFPLSAIFTT

SEQ ID NO: 485 - protein, 89 aa, Artificial
  Synthetic Luk606 HlgC, LukS binding FN3 domain
LPAPKNLVVSRVTEDSARLSWTAPDAAFDSFTIHYLESYPRGEAIVLTVPGSERSYDLTGLKPGTEYFVAIYGVKGGYLSPPLSAIFTT

SEQ ID NO: 486 - protein, 89 aa, Artificial
  Synthetic Luk607 HlgC, LukS binding FN3 domain
LPAPKNLVVSRVTEDSARLSWTAPDAAFDSFQIFYHEWVPWGEAIVLTVPGSERSYDLTGLKPGTEYFVVIHGVKGGTISFPLSAIFTT

SEQ ID NO: 487 - protein, 89 aa, Artificial
  Synthetic Luk608 HlgC, LukS binding FN3 domain
LPAPKNLVVSRVTEDSARLSWTAPDAAFDSFNIFYGEYENGGEAIVLTVPGSERSYDLTGLKPGTEYFVFIIGVKGGPDSLPLSAIFTT

SEQ ID NO: 488 - protein, 89 aa, Artificial
  Synthetic Luk609 HlgC, LukS binding FN3 domain
LPAPKNLVVSRVTEDSARLSWTAPDAAFDSFDIRYWEGPGYGEAIVLTVPGSERSYDLTGLKPGTEYRVRIVGVKGGKRSEPLSAIFTT

SEQ ID NO: 489 - protein, 89 aa, Artificial
  Synthetic Luk610 LukS binding FN3 domain
LPAPKNLVVSRVTEDSARLSWTAPDAAFDSFFIYYGEYDPVGEAIVLTVPGSERSYDLTGLKPGTEYFVIIQGVKGGQASGPLSAIFTT

SEQ ID NO: 490 - protein, 89 aa, Artificial
  Synthetic Luk611 HlgC, LukS binding FN3 domain
LPAPKNLVVSRVTEDSARLSWTAPDAAFDSFHIAYAEFWRYGEAIVLTVPGSERSYDLTGLKPGTEYWVNIAGVKGGEWSKPLSAIFTT

SEQ ID NO: 491 - protein, 89 aa, Artificial
  Synthetic Luk612 HlgC, LukS binding FN3 domain
LPAPKNLVVSRVTEDSARLSWTAPDAAFDSFTIFYQEESKYGEAIVLTVPGSERSYDLTGLKPGTEYFVVIHGVKGGAISQPLSAIFTT

SEQ ID NO: 492 - protein, 89 aa, Artificial
  Synthetic Luk613 HlgC, LukS binding FN3 domain
LPAPKNLVVSRVTEDSARLSWTAPDAAFDSFNIFYIETDKPGEAIVLTVPGSERSYDLTGLKPGTEYFVAIHGVKGGFISEPLSAIFTT

SEQ ID NO: 493 - protein, 89 aa, Artificial
  Synthetic Luk614 HlgC, HlgA, LukS binding FN3 domain
LPAPKNLVVSRVTEDSARLSWTAPDAAFDSFQIFYTEPVGHGEAIVLTVPGSERSYDLTGLKPGTEYFVAIHGVKGGTISPPLSAIFTT

SEQ ID NO: 494 - protein, 89 aa, Artificial
  Synthetic Luk615 HlgC, LukS binding FN3 domain
LPAPKNLVVSRVTEDSARLSWTAPDAAFDSFHIFYIEHRLQGEAIVLTVPGSERSYDLTGLKPGTEYLVLIHGVKGGFISPPLSAIFTT

SEQ ID NO: 495 - protein, 89 aa, Artificial
  Synthetic Luk616 HlgC, LukS binding FN3 domain
LPAPKNLVVSRVTEDSARLSWTAPDAAFDSFHIFYHEGLKSGEAIVLTVPGSERSYDLTGLKPGTEYLVVIHGVKGGTISNPLSAIFTT

SEQ ID NO: 496 - protein, 89 aa, Artificial
  Synthetic Luk617 HlgC, LukS binding FN3 domain
LPAPKNLVVSRVTEDSARLSWTAPDAAFDSFVIFYHETRVTGEAIVLTVPGSERSYDLTGLKPGTEYLVVIHGVKGGYISEPLSAIFTT

SEQ ID NO: 497 - protein, 89 aa, Artificial
  Synthetic Luk618 HlgC, LukS binding FN3 domain
LPAPKNLVVSRVTEDSARLSWTAPDAAFDSFSIFYQEAVEGGEAIVLTVPGSERSYDLTGLKPGTEYFVPIHGVKGGWISQPLSAIFTT

SEQ ID NO: 498 - protein, 89 aa, Artificial
  Synthetic Luk619 LukS binding FN3 domain
LPAPKNLVVSRVTEDSARLSWTAPDAAFDSFQILYVEEFTRGEAIVLTVPGSERSYDLTGLKPGTEYVVIIHGVKGGYISKPLSAIFTT

SEQ ID NO: 499 - protein, 87 aa, Artificial
  Synthetic Luk620 HlgC, LukS binding FN3 domain
LPAPKNLVVSRVTEDSARLSWTAPDAAFDSFTYIEALGFGEAIVLTVPGSERSYDLTGLKPGTEYFVAIYGVKGGYISEPLSAIFTT

SEQ ID NO: 500 - protein, 89 aa, Artificial
  Synthetic Luk621 HlgC, LukS binding FN3 domain
LPAPKNLVVSRVTEDSARLSWTAPDAAFDSFVIFYLEHWNPGEAIVLTVPGSERSYDLTGLKPGTEYLVPIHGVKGGSISPPLSAIFTT

SEQ ID NO: 501 - protein, 89 aa, Artificial
  Synthetic Luk622 HlgC, LukS binding FN3 domain
LPAPKNLVVSRVTEDSARLSWTAPDAAFDSFTIFYVEWEVVGEAIVLTVPGSERSYDLTGLKPGTEYFVVIHGVKGGVISNPLSAIFTT

SEQ ID NO: 502 - protein, 89 aa, Artificial
  Synthetic Luk623 LukS binding FN3 domain
LPAPKNLVVSRVTEDSARLSWTAPDAAFDSFRIFYLEESKNGEAIVLTVPGSERSYDLTGLKPGTEYQVVIHGVKGGVISPPLSAIFTT

SEQ ID NO: 503 - protein, 89 aa, Artificial
  Synthetic Luk624 HlgC, LukS binding FN3 domain
LPAPKNLVVSRVTEDSARLSWTAPDAAFDSFAIFYNEDHKSGEAIVLTVPGSERSYDLTGLKPGTEYLVVIHGVKGGYISKPLSAIFTT

SEQ ID NO: 504 - protein, 88 aa, Artificial
  Synthetic Luk625 HlgC, LukS binding FN3 domain
LPAPKNLVVSRVPEDSARLSWTAPDAAFDSFLIDYQEWHEGEAIHLLVPGSERSYDLTGLKPGTEYAVIIVGVKGGKGSHPLSAIFTT

SEQ ID NO: 505 - protein, 89 aa, Artificial
  Synthetic Luk626 HlgC, LukS binding FN3 domain
LPAPKNLVVSRVTEDSARLSWTAPYAAFDSFWIGYYETTIPGEAIDLVVPGSERSYDLTGLKPGTEYGVGIDGVKGGRYSHPLSAIFTT

SEQ ID NO: 506 - protein, 89 aa, Artificial
  Synthetic Luk627 LukS binding FN3 domain
LPAPKNLVVSRVTEDSARLSWTAPDAAFDSFAIFYKEEAIPGEAIALIVPGSERSYDLTGLKPGTEYFVPIHGVKGGYISTPLSAIFTT

SEQ ID NO: 507 - protein, 89 aa, Artificial
  Synthetic Luk628 LukS binding FN3 domain
LPAPKNLVVSRVTEDSARLSWTAPDAAFDSFLIDYTELHNWGEAIHLFVPGSERSYDLTGLKPGTEYTVLIVGVKGGTGSIPLSAIFTT

SEQ ID NO: 508 - protein, 89 aa, Artificial
  Synthetic Luk629 HlgC, LukS binding FN3 domain
LPAPKNLVVSRVTEDSARLSWTAPDAAFDSFYITYEEEWWTGEAIFLDVPGSERSYDLTGLKPGTEYLVTIKGVKGGPWSQPLSAIFTT

SEQ ID NO: 509 - protein, 89 aa, Artificial
  Synthetic Luk630 LukS binding FN3 domain
LPAPKNLVVSRVTEDSARLSWTAPDAAFDSFAIWYHEWGPVGEAILLYVPGSERSYDLTGLKPGTEYPVAIHGVKGGGTSHPLSAIFTT

SEQ ID NO: 510 - protein, 89 aa, Artificial
  Synthetic Luk631 LukS binding FN3 domain
LPAPKNLVVSRVTEDSARLSWTAPDAAFDSFRIFYEELRYKGEAIWLFVPGSERSYDLTGLKPGTEYHVHIWGVKGGYFSRPLSAIFTT

SEQ ID NO: 511 - protein, 89 aa, Artificial
  Synthetic Luk632 LukS binding FN3 domain
LPAPKNLVVSRVTEDSARLSWTAPDAAFDSFIIDYWEQWNTGEAIHLYVPGSERSYDLTGLKPGTEYSVYIVGVKGGYASWPLSAIFTT

SEQ ID NO: 512 - protein, 89 aa, Artificial
  Synthetic Luk633 HlgC, LukS binding FN3 domain
LPAPKNLVVSRVTEDSARLSWTAPDAAFDSFWIGYDENHLYGEAIDLVVPGSERSYDLTGLKPGTEYTVSIAGVKGGLESFPLSAIFTT

SEQ ID NO: 513 - protein, 89 aa, Artificial
  Synthetic Luk634 LukS binding FN3 domain
LPAPKNLVVSRVTEDSARLSWTAPEAAFDSFHISYWEFPLGGEAIGLWVPGSERSYDLTGLKPGTEYFVIIAGVKGGEFSNPLSAIFTT

SEQ ID NO: 514 - protein, 89 aa, Artificial
  Synthetic Luk635 HlgC, LukS binding FN3 domain
LPAPKNLVVSRVTEDSARLSWTAPDAAFDSFIIEYHEWFAKGEAIGLVVPGSERSYDLTGLKPGTEYSVIIVGVKGGAYSFPLSAIFTT

SEQ ID NO: 515 - protein, 89 aa, Artificial
  Synthetic Luk636 HlgC, LukS binding FN3 domain
LPAPKNLVVSRVTEDSARLSWTAPDAAFDSFLIDYWEGEFDGEAIHLFVPGSERSYDLTGLKPGTEYDVFIVGVKGGHGSDPLSAIFTT

SEQ ID NO: 516 - protein, 89 aa, Artificial
  Synthetic Luk637 HlgC, LukS binding FN3 domain
LPAPKNLVVSRVTEDSARLSWTAPDAAFDSFQIPYYELDSVGEAIVLTVPGSERSYDLTGLKPGTEYFVGIYGVKGGYISPPLSAIFTT

SEQ ID NO: 517 - protein, 89 aa, Artificial
  Synthetic Luk638 LukS binding FN3 domain
LPAPKNLVVSRVTEDSARLSWTAPDAAFDSFYIGYGEYDPTGEAIVLTVPGSERSYDLTGLKPGTEYWVLISGVKGGYYSDPLSAIFTT

SEQ ID NO: 518 - protein, 89 aa, Artificial
  Synthetic Luk639 HlgC, LukS binding FN3 domain
LPAPKNLVVSRVTEDSARLSWTAPDAAFDSFVIYYLESVARGEAIVLTVPGSERSYDLTGLKPGTEYFVPIYGVKGGYISYPLSAIFTT

SEQ ID NO: 519 - protein, 89 aa, Artificial
  Synthetic Luk640 HlgC, LukS binding FN3 domain
LPAPKNLVVSRVTEDSARLSWTAPDAAFDSFTIPYWESYYSGEAIVLTVPGSERSYDLTGLKPGTEYVVAIYGVKGGYISSPLSAIFTT

SEQ ID NO: 520 - protein, 89 aa, Artificial
  Synthetic Luk641 LukS binding FN3 domain
LPAPKNLVVSRVTEDSARLSWTAPDAAFDSFGIYYGEYHSGGEAIVLTVPGSERSYDLTGLKPGTEYFVLIDGVKGGLYSGPLSAIFTT

SEQ ID NO: 521 - protein, 89 aa, Artificial
  Synthetic Luk642 LukS binding FN3 domain
LPAPKNLVVSRVTEDSARLSWTAPDAAFDSFYIVYAEYYWYGEAIVLTVPGSERSYDLTGLKPGTEYYVYIAGVKGGYGSDPLSAIFTT

SEQ ID NO: 522 - protein, 89 aa, Artificial
  Synthetic Luk643 HlgC, LukS binding FN3 domain
LPAPKNLVVSRVTEDSARLSWTAPDAAFDSFTIPYYESNLGGEAIVLTVPGSERSYDLTGLKPGTEYWVGIYGVKGGHISSPLSAIFTT

SEQ ID NO: 523 - protein, 89 aa, Artificial
  Synthetic Luk644 HlgC, LukS binding FN3 domain
LPAPKNLVVSRVTEDSARLSWTAPDAAFDSFTILYYELIDSGEAIVLTVPGSERSYDLTGLKPGTEYFVGIYGVKGGYISLPLSAIFTT

SEQ ID NO: 524 - protein, 89 aa, Artificial
  Synthetic Luk645 HlgC, LukS binding FN3 domain
LPAPKNLVVSRVTEDSARLSWTAPDAAFDSFWISYGEYWPSGEAIVLTVPGSERSYDLTGLKPGTEYFVLIRGVKGGDYSNPLSAIFTT

SEQ ID NO: 525 - protein, 89 aa, Artificial
  Synthetic Luk646 LukD binding FN3 domain
LPAPKNLVVSRVTEDSARLSWTAPDAAFDSFRIFYGEYDGGGEAIVLTVPGSERSYDLTGLKPGTEYGVYIYGVKGGYISQPLSAIFTT

SEQ ID NO: 526 - protein, 89 aa, Artificial
  Synthetic Luk647 LukS binding FN3 domain
LPAPKNLVVSRVTEDSARLSWTAPDAAFDSFSIYYGEWDPTGEAIVLTVPGSERSYDLTGLKPGTEYWVLIVGVKGGSTSAPLSAIFTT

SEQ ID NO: 527 - protein, 89 aa, Artificial
  Synthetic Luk648 LukS binding FN3 domain
LPAPKNLVVSRVTEDSARLSWTAPDAAFDSFWIGYEEYYLVGEAIVLTVPGSERSYDLTGLKPGTEYLVWIKGVKGGYVGRPLSAIFTT

SEQ ID NO: 528 - protein, 89 aa, Artificial
  Synthetic Luk649 LukS binding FN3 domain
LPAPKNLVVSRVTEDSARLSWTAPDAAFDSFGIAYSERVRYGEAIVLTVPGSERSYDLTGLKPGTEYWVGISGVKGGPYSEPLSAIFTT

SEQ ID NO: 529 - protein, 89 aa, Artificial
  Synthetic Luk650 HlgC, LukS binding FN3 domain
LPAPKNLVVSRVTEDSARLSWTAPDAAFDSFTIHYYESYTVGEAIVLTVPGSERSYDLTGLKPGTEYWVGIYGVKGGYISEPLSAIFTT

SEQ ID NO: 530 - protein, 97 aa, Artificial
  Synthetic Luk651 HlgA, LukD, LukAB binding FN3 domain
LPAPKNLVLSRVTEDSARLSWAQATYYQFDSFLIQYQESEKVGEAIVLTVPGSERSYDLTGLKPGTEYTVSIYGVLEVIPKLRYKVYSNPLSAIFTT

SEQ ID NO: 531 - protein, 96 aa, Artificial
  Synthetic Luk652 HlgA binding FN3 domain
LPAPKNLVVSRVTEDSARLSWSEVEDIPFDSFLIQYQESEKVGEAIVLTVPGSERSYDLTGLKPGTEYTVSIYGVLHYNRGQHPWHSNPLSAIFTT

SEQ ID NO: 532 - protein, 97 aa, Artificial
  Synthetic Luk653 HlgA binding FN3 domain
LPAPKNLVVSRVTEDSARLSWNLEVAFYFDSFLIQYQESEKVGEAIVLTVPGSERSYDLTGLKPGTEYTVSIYGVEHLDEVWWTANLSNPLSAIFTT

SEQ ID NO: 533 - protein, 93 aa, Artificial
  Synthetic Luk654 HlgA, LukD binding FN3 domain
LPAPKNLVVSRVTEDSARLSWSHFPNDWFDSFLIQYQESEKVGEAIVLTVPGSERSYDLTGLKPGTEYTVSIYGVHYWQFDIQSNPLSAIFTT

SEQ ID NO: 534 - protein, 97 aa, Artificial
  Synthetic Luk655 HlgA binding FN3 domain
LPAPKNLVVCRVTEDSARLSWRTYTSDAGFDSFLIQYQESEKVGEAIVLTVPGSERSYDLTGLKPGTEYTVSIYGVHEHAHIQYWHWSNPLSAIFTT

SEQ ID NO: 535 - protein, 98 aa, Artificial
  Synthetic Luk656 HlgA binding FN3 domain
LPAPKNLVVSRVTEDSARLSWKREQWANYFDSFLIQYQESEKVGEAIVLTVPGSERSYDLTGLKPGTEYTVSIYGVWEHLYKELWSYTSNPLSAIFTT

SEQ ID NO: 536 - protein, 95 aa, Artificial
  Synthetic Luk657 LukF binding FN3 domain
LPAPKNLVVSRVTEDSARLSWSELEARTHFDSFLIQYQESEKVSEAIVLTVPGSERSYDLTGLKPGTEYTVSIYGVAQQLVAWRGSNPLSAIFTT

SEQ ID NO: 537 - protein, 94 aa, Artificial
  Synthetic Luk658 LukD binding FN3 domain
LPAPKNLVVSRVTEDSARLSWKRARLDLPFDSFLIQYQESEKVGEAIVLTVPGSERSYDLTGLKPGTEYTVSIYGVDAWIPTVGSNPLSAIFTT

SEQ ID NO: 538 - protein, 97 aa, Artificial
  Synthetic Luk659 HlgA binding FN3 domain
LPAPKNLVVSRVTEDSARLSWINYWVLNYFDSFLIQYQESEKVGEAIVLTVPGSERSYDLTGLKPGTEYTVSIYGVEVWPQDHEWIDSNPLSAIFTT

SEQ ID NO: 539 - protein, 93 aa, Artificial
  Synthetic Luk660 HlgA binding FN3 domain
LPAPKNLVVSRVTEDSARLSWYREVDFTTFDSFLIQYQESEKVGEAIVLTVPGSERSYDLTGLKPGTEYTVSIYGVSSYYILHSNPLSAIFTT

SEQ ID NO: 540 - protein, 89 aa, Artificial
  Synthetic Luk661 LukAB binding FN3 domain
LPAPKNLVVSRVTEDSARLSWTAPDAAFDSFLITYREQIFAGEVIVLTVPGSERSYDLTGLKPGTEYPVCIYGVKGGPISDPLSAIFTT

SEQ ID NO: 541 - protein, 74 aa, Artificial
  Synthetic Luk662 LukS binding FN3 domain
LPAPKNLVVSRVTEDSARLSWTAPDAAFDSFVINYREVINEGEAIILHVPGSERSYRPERSETGYRIHRHHSWC

SEQ ID NO: 542 - protein, 94 aa, Artificial
  Synthetic Luk663 LukD binding FN3 domain
LPAPKNLVVSRVTEDSARLSWVVHNHLAFDSFLIQYQESEKVGEAIVLTVPGSERSYDLTGLKPGTEYTVSIYGVEPYVYAQYESNPLSAIFTT

SEQ ID NO: 543 - protein, 93 aa, Artificial
  Synthetic Luk664 HlgC binding FN3 domain
LPAPKNLVVSRVTEDSARLSWKRKSGAPFDSFLIQYQESEKVGEAIVLTVPGSERSYDLTGLKPGTEYTVSIYGVHGWDPGSDSNPLSAIFTT

SEQ ID NO: 544 - protein, 92 aa, Artificial
  Synthetic Luk665 HlgC binding FN3 domain
LPAPKNLVVSRVTEDSARLSWWHVRGHDFDSFLIQYQESEKVGEAIVLTVPGSERSYDLTGLKPGTEYTVSIYGVVWLPTTDSNPLSAIFTT

SEQ ID NO: 545 - protein, 92 aa, Artificial
  Synthetic Luk666 HlgC binding FN3 domain
LPAPKNLVVSRVTEDSARLSWSPDRARFDSFLIQYQESEKVGEAIVLTVPGSERSYDLTGLKPGTEYTVSIYGVWSWDNDDASNPLSAIFTT

SEQ ID NO: 546 - protein, 96 aa, Artificial
  Synthetic Luk667 HlgC binding FN3 domain
LPAPKNLVVSRVTEDSARLSWFAGLQLFDSFLIQYQESEKVGEAIVLTVPGSERSYDLTGLKPGTEYTVSIYGVDWTVEEQSYHLWSNPLSAIFTT

SEQ ID NO: 547 - protein, 95 aa, Artificial
  Synthetic Luk668 HlgC binding FN3 domain
LPAPKNLVVSRVTEDSARLSWTIPHYTFDSFLIQYQESEKVGEAIVLTVPGSERSYDLTGLKPGTEYTVSIYGVPGKYIEPRWHFSNPLSAIFTT

SEQ ID NO: 548 - protein, 92 aa, Artificial
  Synthetic Luk669 HlgC binding FN3 domain
LPAPKNLVVSRVTEDSARLSWKRYSWLFDSFLIQYQESEKVGEAIVLTVPGSERSYDLTGLKPGTEYTVSIYGVLTWDPNDPSNPLSAIFTT

SEQ ID NO: 549 - protein, 97 aa, Artificial
  Synthetic Luk670 HlgC binding FN3 domain
LPAPKNLVVSRVTEDSARLSWKTIVTTIFDSFLIQYQESEKVGEAIVLTVPGSERSYDLTGLKPGTEYTVSIYGVDHRGFPFWQYWSSNPLSAIFTT

SEQ ID NO: 550 - protein, 92 aa, Artificial
  Synthetic Luk671 LukS binding FN3 domain
LPAPKNLVVSRVTEDSARLSWYARRIYFDSFLIQYQESEKVGEAIVLTVPGSERSYDLTGLKPGTEYTVSIYGVETPNPYYDSNPLSAIFTT

SEQ ID NO: 551 - protein, 96 aa, Artificial
  Synthetic Luk672 HlgC binding FN3 domain
LPAPKNLVVSRVTEDSARLSWNLEQSTFDSFLIQYQESEKVGEAIVLTVPGSERSYDLTGLKPGTEYTVSIYGVTTYRITVPVRDHSNPLSAIFTT

SEQ ID NO: 552 - protein, 94 aa, Artificial
  Synthetic Luk673 LukS binding FN3 domain
LPAPKNLVVSRVTEDSARLSWRAAGTGFDSFLIQYQESEKVGEAIVLTVPGSERSYDLTGLKPGTEYTVSIYGVNWQPDYWTWPSNPLSAIFTT

SEQ ID NO: 553 - protein, 93 aa, Artificial
  Synthetic Luk674 HlgC binding FN3 domain
LPAPKNLVVSRVTEDSARLSWPISHLSFDSFLIQYQESEKVGEAIVLTVPGSERSYDLTGLKPGTEYTVSIYGVWHQTVGRWFSNPLSAIFTT

SEQ ID NO: 554 - protein, 93 aa, Artificial
  Synthetic Luk675 HlgC binding FN3 domain
LPAPKNLVVSRVTEDSARLSWVRKKVNRFDSFLIQYQESEKVGEAIVLTVPGSERSYDLTGLKPGTEYTVSIYGVRNWKPNDPSNPLSAIFTT

SEQ ID NO: 555 - protein, 93 aa, Artificial
  Synthetic Luk676 HlgC binding FN3 domain
LPAPKNLVVSRVTEDSARLSWVSATQHPFDSFLIQYQESEKVGEAIVLTVPGSERSYDLTGLKPGTEYTVSIYGVDNWDPTDPSNPLSAIFTT

SEQ ID NO: 556 - protein, 92 aa, Artificial
  Synthetic Luk677 HlgC binding FN3 domain
LPAPKNLVVSRVTEDSARLSWPIALRDFDSFLIQYQESEKVGEAIVLTVPGSERSYDLTGLKPGTEYTVSIYGVISWDPTDPSNPLSAIFTT

SEQ ID NO: 557 - protein, 98 aa, Artificial
  Synthetic Luk678 HlgC binding FN3 domain
LPAPKNLVVSRVTEDSARLSWWDAEWFAPHFDSFLIQYQESEKVGEAIVLTVPGSERSYDLTGLKPGTEYTVSIYGVGLLKWPNYAVLSNPLSAIFTT

SEQ ID NO: 558 - protein, 95 aa, Artificial
  Synthetic Luk679 HlgC binding FN3 domain
LPAPKNLVVSRVTEDSARLSWPNNQRYYQPFDSFLIQYQESEKVGEAIVLTVPGSERSYDLTGLKPGTEYTVSIYGVLSWNPHHWSNPLSAIFTT

SEQ ID NO: 559 - protein, 98 aa, Artificial
  Synthetic Luk680 HlgC binding FN3 domain
LPAPKNLVVSRVTEDSARLSWYDARVTDEFFDSFLIQYQESEKVGEAIVLTVPGSERSYDLTGLKPGTEYTVSIYGVDDLLTNHLLAISNPLSAIFTT

SEQ ID NO: 560 - protein, 94 aa, Artificial
  Synthetic Luk681 HlgC binding FN3 domain
LPAPKNLVVSRVTEDSARLSWKKRNTLKIFDSFLIQYQESEKVGEAIVLTVPGSERSYDLTGLKPGTEYTVSIYGVETWDPNDWSNPLSAIFTT

SEQ ID NO: 561 - protein, 94 aa, Artificial
  Synthetic Luk682 HlgC binding FN3 domain
LPAPKNLVVSRVTEDSARLSWLNRVKPNDFDSFLIQYQESEKVGEAIVLTVPGSERSYDLTGLKPGTEYTVSIYGVITWHPGHWSNPLSAIFTT

SEQ ID NO: 562 - protein, 94 aa, Artificial
  Synthetic Luk683 LukD binding FN3 domain
LPAPKNLVVSRVTEDSARLSWLTVRFTKFEFDSFLIQYQESEKVGEAIVLIVPGSERSYDLTGLKPGTEYTVSIYGVRSSKPRASNPLSAIFTT

SEQ ID NO: 563 - protein, 95 aa, Artificial
  Synthetic Luk684 HlgC binding FN3 domain
LPAPKNLVVSRVTEDSARLSWPNYRKVVSVFDSFLIQYQESEKVGEAIVLTVPGSERSYDLTGLKPGTEYTVSIYGVHTWHPGHYSNPLSAIFTT

SEQ ID NO: 564 - protein, 95 aa, Artificial
  Synthetic Luk685 HlgC binding FN3 domain
LPAPKNLVVSRVTEDSARLSWGNRQQVRSAFDSFLIQYQESEKVGEAIVLTVPGSERSYDLTGLKPGTEYTVSIYGVVGWHPNHPSNPLSAIFTT

SEQ ID NO: 565 - protein, 57 aa, Artificial
  Synthetic Luk686 HlgC binding FN3 domain
LPARKTWLFLVLPKTLRVCLGPRRTRRSTLFGLRTQRLLSGGKRLACWCRVLNVLTT

SEQ ID NO: 566 - protein, 46 aa, Artificial
  Synthetic Luk687 HlgC, LukS binding FN3 domain
LPARKTWLFLVLPKTLRVCLGPRRTRRSTLSGLHTQRRHPGVKRSA

SEQ ID NO: 567 - protein, 89 aa, Artificial
  Synthetic Luk688 HlgC binding FN3 domain
LPAPKNLVVSRVTEDSARLSWTAPDAAFDSFGIEGGEYYYVGEAIVLTVPGSERSYDLTGLKPGTEYGVPIGGVKGGPNSHPLSAIFTT

SEQ ID NO: 568 - protein, 95 aa, Artificial
  Synthetic Luk689 LukD, LukAB binding FN3 domain
LPAPKNLVVSRVTEDSARLSWWFYLTSWFAFDSFLIQYQESEKVGEAIVLTVPGSERSYDLTGLKPGTEYTVSIYGVLKVDPHVRSNPLSAIFTT

SEQ ID NO: 569 - protein, 97 aa, Artificial
  Synthetic Luk690 HlgB binding FN3 domain
LPAPKNLVVSRVTEDSARLSWYHVNFGFFDSFLIQYQESEKVGEAIVLTVPGSERSYDLTGLKPGTEYTVSIYGVYEDYPVIIFNNRSNPLSAIFTT

SEQ ID NO: 570 - protein, 94 aa, Artificial
  Synthetic Luk691 LukF binding FN3 domain
LPAPKNLVVSRVTEDSARLSWEDIKNKRFDSFLIQYQESEKVGEAIVLTVPGSERSYDLTGLKPGTEYTVSIYGVRGLANPFRVSNPLSAIFTT

SEQ ID NO: 571 - protein, 96 aa, Artificial
  Synthetic Luk692 HlgB, LukD binding FN3 domain
LPAPKNLVVSRVTEDSARLSWWRYGPWFHFDSFLIQYQESEKVGEAIVLTVPGSERSYDLTGLKPGTEYTVSIYGVRTHVRPPQWVSNPLSAIFTT

SEQ ID NO: 572 - protein, 96 aa, Artificial
  Synthetic Luk693 HlgB, LukD binding FN3 domain
LPAPKAAVVSRVTEDSARLSWWRYGPWFHFDSFLIQYQESEKVGEAIVLTVPGSERSYDLTGLKPGTEYTVSIYGVRTHVRPPQWVSNPLSAIFTT

SEQ ID NO: 573 - protein, 97 aa, Artificial
  Synthetic Luk694 HlgB binding FN3 domain
LPAPKNLVVSRVTEDSARLSWTNYYLESRHFDSFLIQYQESEKVGEAIVLTVPGSERSYDLTGLKPGTEYTVSIYGVRGQFGWYIEASNPLSAIFTT

SEQ ID NO: 574 - protein, 98 aa, Artificial
  Synthetic Luk695 LukD, LukAB binding FN3 domain
LPAPKNLVVSRVTEDSARLSWLNWEQYITFDSFLIQYQESEKVGEAIVLTVPGSERSYDLTGLKPGTEYTVSIYGVWIIRDRSHWLNPSNPLSAIFTT

SEQ ID NO: 575 - protein, 34 aa, Artificial
  Synthetic Luk696 HlgB binding FN3 domain
LPAPKNLWLFLVLPKTLPVCLGGVMARGSTSTLS

SEQ ID NO: 576 - protein, 95 aa, Artificial
  Synthetic Luk697 HlgB binding FN3 domain
LPAPKNLVVSRVTEDSARLSWERFGPWFHFDSFLIQYQESEKVGEAIVLTVPGSERSYDLTGLKPGTEYTVSIYGVKTQPEQEFKSNPLSAIFTT

SEQ ID NO: 577 - protein, 96 aa, Artificial
  Synthetic Luk698 HlgB binding FN3 domain
LPAPKNLVVSRVTEDSARLSWWRYGPWFHFDSFLIQYQESEKVGEAIVLTVPGSERSYDLTGLKPGTEYTVSIYGVRTHVRPPQWISYPLSAIFTT

SEQ ID NO: 578 - protein, 94 aa, Artificial
  Synthetic Luk699 HlgB binding FN3 domain
LPAPKNLVVSRVTEDSARLSWWRYGPWFHFDSFLIQYQESEKVGEAIVLTVPGSERSYDLTGLKPGTEYTVSIYGVKQHHSLFHSNPLSAIFTT

SEQ ID NO: 579 - protein, 93 aa, Artificial
  Synthetic Luk700 LukD binding FN3 domain
LPAPKNLVVSRVTEDSARLSWNQQLNYQYFDSFLIQYQESEKVGEAIVLTVPGSERSYDLTGLKPGTEYTVSIYGVWYRWWSGSNPLSAIFTT

SEQ ID NO: 580 - protein, 97 aa, Artificial
  Synthetic Luk701 HlgB binding FN3 domain
LPAPKNLVVSRVTEDSARLSWWRYGPWFHFDSFLIQYQESEKVGEAIVLTVPGSERSYDLTGLKPGTEYTVSIYGVRTHNNQPGHYTSNPLSAIFTT

SEQ ID NO: 581 - protein, 96 aa, Artificial; identical to SEQ ID NO: 571
  Synthetic Luk702 HlgB binding FN3 domain

SEQ ID NO: 582 - protein, 96 aa, Artificial
  Synthetic Luk703 HlgB, LukD binding FN3 domain
LPAPKALVVSRVTEDSARLSWWRYGPWFHFDSFLIQYQESEKVGEAIVLTVPGSERSYDLTGLKPGTEYTVSIYGVRTHVRPPQWVSNPLSAIFTT

SEQ ID NO: 583 - protein, 89 aa, Artificial
  Synthetic Luk704 LukD binding FN3 domain
LPAPKNLVVSRVTEDSARLSWTAPDAAFDSFPILYQERWWKGEAIVLTVPGSERSYDLTGLKPGTEYGVPITGVKGGGVSFPLSAIFTT

SEQ ID NO: 584 - protein, 89 aa, Artificial
  Synthetic Luk705 LukAB binding FN3 domain
LPAPKNLVVSRVTEDSARLSWTAPDAAFDSFHIWYRESWYFGEAIVLTVPGSERSYDLTGLKPGTEYYVVIRGVKGGSLSWPLSAIFTT

SEQ ID NO: 585 - protein, 89 aa, Artificial
  Synthetic Luk706 HlgB binding FN3 domain
LPAPKNLVVSRVTEDSARLSWTAPDAAFDSFPISYYEQPRRGEAIWLFVPGSERSYDLTGLKPGTEYTVYITGVKGGTWSFPLTATFTT

SEQ ID NO: 586 - protein, 89 aa, Artificial
  Synthetic Luk707 LukE binding FN3 domain
LPAPKNLVVSRVTEDSARLSWTAPDAAFDSFGIEYYETKTKGEAINLFVPGSERSYDLTGLKPGTEYYVIILGVKGGEPSSPLVAPFTT

SEQ ID NO: 587 - protein, 95 aa, Artificial
  Synthetic Luk708 LukAB binding FN3 domain
LPAPKNLVVSRVTEDSARLSWKDVGEWKFDSFLIQYQESEKVGEAIVLTVPGSERSYDLTGLKPGTEYTVSIYGVHQLTITYSPTSNPLSAIFTT

SEQ ID NO: 588 - protein, 96 aa, Artificial
  Synthetic Luk709 LukAB binding FN3 domain
LPAPKNLVVSRVTEDSARLSWKRSYHPNFDSFLIQYQESEKVGEAIVLTVPGSERSYDLTGLKPGTEYTVSIYGVIDVPTVYHPGRSNPLSAIFTT

SEQ ID NO: 589 - protein, 95 aa, Artificial
  Synthetic Luk710 LukAB binding FN3 domain
LPAPKNLVVSRVTEDSARLSWLKKVSKFDSFLIQYQESEKVGEAIVLTVPGSERSYDLTGLKPGTEYTVSIYGVGEFPDRIYWGASNPLSAIFTT

SEQ ID NO: 590 - protein, 96 aa, Artificial
  Synthetic Luk711 LukAB binding FN3 domain
LPAPKNLVVSRVTEDSARLSWYYWVQTIFDSFLIQYQESEKVGEAIVLTVPGSERSYDLTGLKPGTEYTVSIYGVGNLPDIFYKLPSNPLSAIFTT

SEQ ID NO: 591 - protein, 91 aa, Artificial
  Synthetic Luk712 LukAB binding FN3 domain
LPAPKNLVVSRVTEDSARLSWSKKLENFDSFLIQYQESEKVGEAIVLTVPGSERSYDLTGLKPGTEYTVSIYGVYHTHLIFSNPLSAIFTT

SEQ ID NO: 592 - protein, 92 aa, Artificial
  Synthetic Luk713 LukAB binding FN3 domain
LPAPKNLVVSRVTEDSARLSWHDLTIWPFDSFLIQYQESEKVGEAIVLTVPGSERSYDLTGLKPGTEYTVSIYGVVIEFEAWSNPLSAIFTT

SEQ ID NO: 593 - protein, 97 aa, Artificial
  Synthetic Luk714 LukAB binding FN3 domain
LPAPKNLVVSRVTEDSARLSWFPWTEWSAFDSFLIQYQESEKVGEAIVLTVPGSERSYDLTGLKPGTEYTVSIYGVENWLVLATATWSNPLSAIFTT

SEQ ID NO: 594 - protein, 97 aa, Artificial
  Synthetic Luk715 LukAB binding FN3 domain
LPAPKNLVVSRVTEDSARLSWVEWWIRPIEFDSFLIQYQESEKVGEAIVLTVPGSERSYDLTGLKPGTEYTVSIYGVWQQLYVEILISNPLSAIFTT

SEQ ID NO: 595 - protein, 95 aa, Artificial
  Synthetic Luk716 LukAB binding FN3 domain
LPAPKNLVVSRVTEDSARLSWSSQRTLPREFDSFLIQYQESEKVGEAIVLTVPGSERSYDLTGLKPGTEYTVSIYGVHVIIHSGSSNPLSAIFTT

SEQ ID NO: 596 - protein, 98 aa, Artificial
  Synthetic Luk717 LukAB binding FN3 domain
LPAPKNLVVSRVTEDSARLSWTSRLEDFWFDSFLIQYQESEKVGEAIVLTVPGSERSYDLTGLKPGTEYTVSIYGVGSEVYFRYYEHWSNPLSAIFTT

SEQ ID NO: 597 - protein, 98 aa, Artificial
  Synthetic Luk718 LukAB binding FN3 domain
LPAPKNLVVSRVTEDSARLSWQVNRNAQFHFDSFLIQYQESEKVGEAIVLTVPGSERSYDLTGLKPGTEYTVSIYGVAHPKLVWFAPPSNPLSAIFTT

SEQ ID NO: 598 - protein, 97 aa, Artificial
  Synthetic Luk719 LukAB binding FN3 domain
LPAPKNLVVSRVTEDSARLSWTFLEKWFIFDSFLIQYQESEKVGEAIVLTVPGSERSYDLTGLKPGTEYTVSIYGVVKHHDHDPEYPSNPLSAIFTT

SEQ ID NO: 599 - protein, 95 aa, Artificial
  Synthetic Luk720 LukAB binding FN3 domain
LPAPKNLVVSRVTEDSARLSWRHPRIQGGHFDSFLIQYQESEKVGEAIVLTVPGSERSYDLTGLKPGTEYTVSIYGVIHPFWWSPSNPLSAIFTT

SEQ ID NO: 600 - protein, 95 aa, Artificial
  Synthetic Luk721 LukAB binding FN3 domain
LPAPKNLVVSRVTEDSARLSWYNAKKITPFFDSFLIQYQESEKVGEAIVLTVPGSERSYDLTGLKPGTEYTVSIYGVYPEVQHTTSNPLSAIFTT

SEQ ID NO: 601 - protein, 91 aa, Artificial
  Synthetic Luk722 LukAB binding FN3 domain
LPAPKNLVVSRVTEDSARLSWTEPWQEFDSFLIQYQESEKVGEAIVLTVPGSERSYDLTGLKPGTEYTVSIYGVILPTLHKSNPLSAIFTT

SEQ ID NO: 602 - protein, 97 aa, Artificial
  Synthetic Luk723 LukAB binding FN3 domain
LPAPKNLVVSRVTEDSARLSWYRFPRIHFDSFLIQYQESEKVGEAIVLTVPGSERSYDLTGLKPGTEYTVSIYGVHTNIDLHNYNYLSNPLSAIFTT

SEQ ID NO: 603 - protein, 96 aa, Artificial
  Synthetic Luk724 LukAB binding FN3 domain
LPAPKNLVVSRVTEDSARLSWAERHPWFDSFLIQYQESEKVGEAIVLTVPGSERSYDLTGLKPGTEYTVSIYGVLRQNINIQDTNYSNPLSAIFTT

SEQ ID NO: 604 - protein, 94 aa, Artificial
  Synthetic Luk725 LukAB binding FN3 domain
LPAPKNLVVSRVTEDSARLSWPWWEGWTFDSFLIQYQESEKVGEAIVLTVPGSERSYDLTGLKPGTEYTVSIYGVKIRTLKASRSNPLSAIFTT

SEQ ID NO: 605 - protein, 96 aa, Artificial
  Synthetic Luk726 LukAB binding FN3 domain
LPAPKNLVVSRVTEDSARLSWAANFIDFDSFLIQYQESEKVGEAIVLTVPGSERSYDLTGLKPGTEYTVSIYGVYSPKLRWDLLNYSNPLSAIFTT

SEQ ID NO: 606 - protein, 96 aa, Artificial
  Synthetic Luk727 LukAB binding FN3 domain
LPAPKNLVVSRVTEDSARLSWFKQEFEFDSFLIQYQESEKVGEAIVLTVPGSERSYDLTGLKPGTEYTVSIYGVYYPEYYPREPWPSNPLSAIFTT

SEQ ID NO: 607 - protein, 92 aa, Artificial
  Synthetic Luk728 LukAB binding FN3 domain
LPAPKNLVVSRVTEDSARLSWEDEGTQFDSFLIQYQESEKVGEAIVLTVPGSERSYDLTGLKPGTEYTVSIYGVHWYWYWQRSNPLSAIFTT

SEQ ID NO: 608 - protein, 97 aa, Artificial
  Synthetic Luk729 LukAB binding FN3 domain
LPAPKNLVVSRVTEDSARLSWFGNQTGARSFDSFLIQYQESEKVGEAIVLTVPGSERSYDLTGLKPGTEYTVSIYGVYYQFRRTVRNSNPLSAIFTT

SEQ ID NO: 609 - protein, 98 aa, Artificial
  Synthetic Luk730 LukAB binding FN3 domain
LPAPKNLVVSRVTEDSARLSWGENRFVLSFDSFLIQYQESEKVGEAIVLTVPGSERSYDLTGLKPGTEYTVSIYGVLYHARHTWWLQQSNPLSAIFTT

SEQ ID NO: 610 - protein, 96 aa, Artificial
  Synthetic Luk731 LukAB binding FN3 domain
LPAPKNLVVSRVTEDSARLSWEKQQLKKWSFDSFLIQYQESEKVGEAIVLTVPGSERSYDLTGLKPGTGYTVSIYGVEHSNTRKRHSNPLSAIFTT

SEQ ID NO: 611 - protein, 97 aa, Artificial
  Synthetic Luk732 LukAB binding FN3 domain
LPAPKNLVVSRVTEDSARLSWKINDNSGYFDSFLIQYQESEKVGEAIVLTVPGSERSYDLTGLKPGTEYTVSIYGVAHRYENNPTLWSNPLSAIFTT

SEQ ID NO: 612 - protein, 98 aa, Artificial
  Synthetic Luk733 LukAB binding FN3 domain
LPAPKNLVVSRVTEDSARLSWPAFRWQPPGFDSFLIQYQESEKVGEAIVLTVPGSERSYDLTGLKPGTEYTVSIYGVGGFLYPWNYPTSNPLSAIFTT

SEQ ID NO: 613 - protein, 99 aa, Artificial
  Synthetic Luk734 LukAB binding FN3 domain
LPAPKNLVVSRVTEDSARLSWISEKPTTSLFDSFLIQYQESEKVGEAIVLTVPGSERSYDLTGLKPGTEYTVSIYGVWPRAIHYAYWFNSNPLSAIFTT

SEQ ID NO: 614 - protein, 97 aa, Artificial
  Synthetic Luk735 LukAB binding FN3 domain
LPAPKNLVVSRVTEDSARLSWQKSFQLTPFDSFLIQYQESEKVGEAIVLTVPGSERSYDLTGLKPGTEYTVSIYGVVVEYKWAATNPSNPLSAIFTT

SEQ ID NO: 615 - protein, 94 aa, Artificial
  Synthetic Luk736 LukAB binding FN3 domain
LPAPKNLVVSRVTEDSARLSWNASLNANHFDSFLIQYQESEKVGEAIVLTVPGSERSYDLTGLKPGTEYTVSIYGVVTSESNYGSNPLSAIFTT

SEQ ID NO: 616 - protein, 96 aa, Artificial
  Synthetic Luk737 LukAB binding FN3 domain
LPAPKNLVVSRVTEDSARLSWTNTARLNKFDSFLIQYQESEKVGEAIVLTVPGSERSYDLTGLKPGTEYTVSIYGVAITHSHHHHSSNPLSAIFTT

SEQ ID NO: 617 - protein, 89 aa, Artificial
  Synthetic Luk738 LukAB binding FN3 domain
LPAPKNLVVSRVTEDSARLSWTAPDAAFDSFHILYWEPTPIGEAILLNVPGSERSYDLTGLKPGTEYNVEIDGVKGGNPSDPLSAIFTT

SEQ ID NO: 618 - protein, 89 aa, Artificial
  Synthetic Luk739 LukAB binding FN3 domain
LPAPKNLVVSRVTEDSARLSWTAPDAAFDSFSISYREGGQHGEAIVLTVPGSERSYDLTGLKPGTEYSVYILGVKGGDESEPLSAIFTT

SEQ ID NO: 619 - protein, 92 aa, Artificial
  Synthetic Luk740 LukAB binding FN3 domain
LPAPKNLVVSRVTEDSARLSWPWWNKHFDSFLIQYQESEKVGEAIVLTVPGSERSYDLTGLKPGTEYTVSIYGVIQWKKKPFSNPLSAIFTT

SEQ ID NO: 620 - protein, 96 aa, Artificial
  Synthetic Luk741 LukAB binding FN3 domain
LPAPKNLVVSRVTEDSARLSWPWWNKHFDSFLIQYQESEKVGEAIVLTVPGSERSYDLTGLKPGTEYTVSIYGVGEHDWYLLNYAESNPLSAIFTT

SEQ ID NO: 621 - protein, 96 aa, Artificial
  Synthetic Luk742 LukAB binding FN3 domain
LPAPKNLVVSRVTEDSARLSWWAFSYLQFDSFLIQYQESEKVGEAIVLTVPGSERSYDLTGLKPGTEYTVSIYGVVEVRENSWNHSSNPLSAIFTT

SEQ ID NO: 622 - protein, 93 aa, Artificial
  Synthetic Luk743 LukAB binding FN3 domain
LPAPKNLVVSRVTEDSARLSWRETHNPQFDSFLIQYQESEKVGEAIVLTVPGSERSYDLTGLKPGTEYTVSIYGVIQWKKKPFSNPLSAIFTT

SEQ ID NO: 623 - protein, 96 aa, Artificial
  Synthetic Luk744 LukAB binding FN3 domain
LPAPKNLVVSRVTEDSARLSWTTRVDEFDSFLIQYQESEKVGEAIVLTVPGSERSYDLTGLKPGTEYTVSIYGVKWYNWKKNVNTESNPLSAIFTT

SEQ ID NO: 624 - protein, 96 aa, Artificial
  Synthetic Luk745 LukAB binding FN3 domain
LPAPKNLVVSRVTEDSARLSWSQKDINFFDSFLIQYQESEKVGEAIVLTVPGSERSYDLTGLKPGTEYTVSIYGVLWYNWKKNWDNSNPLSAIFTT

SEQ ID NO: 625 - protein, 93 aa, Artificial
  Synthetic Luk746 LukAB binding FN3 domain
LPAPKNLVVSRVTEDSARLSWFTTNNHWFDSFLIQYQESEKVGEAIVLTVPGSERSYDLTGLKPGTEYTVSIYGVIQWKKKPFSNPLSAIFTT

SEQ ID NO: 626 - protein, 94 aa, Artificial
  Synthetic Luk747 LukAB binding FN3 domain
LPAPKNLVVSRVTEDSARLSWGRAREPASFDSFLIQYQESEKVGEAIVLTVPGSERSYDLTGLKPGTEYTVSIYGVLTVLFIDSSNPLSAIFTT

SEQ ID NO: 627 - protein, 98 aa, Artificial
  Synthetic Luk748 LukAB binding FN3 domain
LPAPKNLVVSRVTEDSVRLSWYNWKKKRLKFDSFLIQYQESEKVGEAIVLTVPGSERSYDLTGLKPGTEYTVSIYGVPNLWDIWNWVLSNPLSAIFTT

SEQ ID NO: 628 - protein, 95 aa, Artificial
  Synthetic Luk749 LukAB binding FN3 domain
LPAPKNLVVSRVTEDSARLSWGTFNLEVYIFDSFLIQYQESEKVGEAIVLTVPGSERSYDLTGLKPGTEYTVSIYGVVSANWHGHSNPLSAIFTT

SEQ ID NO: 629 - protein, 97 aa, Artificial
  Synthetic Luk750 LukAB binding FN3 domain
LPAPKNLVVSRVTEDSARLSWPQIFNELWEFDSFLIQYQESEKVGEAIVLTVPGSERSYDLTGLKPGTEYTVSIYGVWWYNRKKKRQSNPLSAIFTT

SEQ ID NO: 630 - protein, 97 aa, Artificial
  Synthetic Luk751 LukAB binding FN3 domain
LPAPKNLVVSRVTEDSARLSWYNEQKKPINFDSFLIQYQESEKVGEAIVLTVPGSERSYDLTGLKPGTEYTVSIYGVWWYNRKKKRQSNPLSAIFTT

SEQ ID NO: 631 - protein, 97 aa, Artificial
  Synthetic Luk752 LukAB binding FN3 domain
LPAPKNLVVSRVTEDSARLSWRGKYSVVDFDSFLIQYQESEKVGEAIVLTVPGSERSYDLTGLKPGTEYTVSIYGVPWYNWKKKYVISNPLSAIFTT

SEQ ID NO: 632 - protein, 96 aa, Artificial
  Synthetic Luk753 LukAB binding FN3 domain
LPAPKNLVVSRVTEDSARLSWYNTKKNPVFDSFLIQYQESEKVGEAIVLTVPGSERSYDLTGLKPGTEYTVSIYGVWLIKSLNAWFSNPLSAIFTT

SEQ ID NO: 633 - protein, 89 aa, Artificial
  Synthetic Luk754 LukAB binding FN3 domain
LPAPKNLVVSRVTEDSARLSWTAPDAAFDSFVIIYEEVQWRGEAIRLFVPGSERSYDLTGLKPGTEYDVNIRGVKGGGSSAPLSAIFTT

SEQ ID NO: 634 - protein, 95 aa, Artificial
  Synthetic Luk755 LukAB binding FN3 domain
LPAPKNLVVSRVTEDSARLSWYNWKKKPGYFDSFLIQYQESEKVGEAIVLTVPGSERSYDLTGLKPGTEYTVSIYGVVHYHEWLASNPLSAIFTT

SEQ ID NO: 635 - protein, 99 aa, Artificial
  Synthetic Luk756 LukAB binding FN3 domain
LPAPKNLVVSRVTEDSARLSWYTVKKKPQKFDSFLIQYQESEKVGEAIVLTVPGSERSYDLTGLKPGTEYTVSIYGVLDAYPIAEWPAQSNPLSAIFTT

SEQ ID NO: 636 - protein, 95 aa, Artificial
  Synthetic Luk757 LukAB binding FN3 domain
LPAPKNLVVSRVTEDSARLSWYNTKKKPQFDSFLIQYQESEKVGEAIVLTVPGSERSYDLTGLKPGTEYTVSIYGVNEFILRWEGSNPLSAIFTT

SEQ ID NO: 637 - protein, 89 aa, Artificial
  Synthetic Luk758 LukAB binding FN3 domain
LPAPKNLVVSRVTEDSARLSWTAPDAAFDSFYIGYYELIGAGEAIVLTVPGSERSYDLTGLKPGTEYGVGIQGVKGGSYSAPLSAIFTT

SEQ ID NO: 638 - protein, 95 aa, Artificial
  Synthetic Luk759 LukAB binding FN3 domain
LPAPKNLVVSRVTEDSARLSWYDRKVEFDSFLIQYQESEKVGEAIVLTVPGSERSYDLTGLKPGTEYTVSIYGVGVDGWGYLLLVSNPLSAIFTT

SEQ ID NO: 639 - protein, 96 aa, Artificial
  Synthetic Luk760 LukAB binding FN3 domain
LPAPKNLVVSRVTEDSARLSWIVPRTFHFDSFLIQYQESEKVGEAIVLTVPGSERSYDLTGLKPGTEYTVSIYGVWSQYITHWLPKSNPLSAIFTT

SEQ ID NO: 640 - protein, 90 aa, Artificial
  Synthetic Luk761 LukAB binding FN3 domain
LPAPKNLVVSRVTEDSARLSWNYRVATFDSFLIQYQESEKVGEAIVLTVPGSERSYDLTGLKPGTEYTVSIYGVSVELLSSNPLSAIFTT

SEQ ID NO: 641 - protein, 95 aa, Artificial
  Synthetic Luk762 LukAB binding FN3 domain
LPAPKNLVVSRVTEDSARLSWQPHRYEFYQFDSFLIQYQESEKVGEAIVLTVPGSERSYDLTGLKPGTEYTVSIYGVADFEFELHSNPLSAIFTT

SEQ ID NO: 642 - protein, 95 aa, Artificial
  Synthetic Luk763 LukAB binding FN3 domain
LPAPKNLVVSRVTEDSARLSWIPSYHLFAFDSFLIQYQESEKVGEAIVLTVPGSERSYDLTGLKPGTEYTVSIYGVNDAEQRYHHSNPLSAIFTT

SEQ ID NO: 643 - protein, 95 aa, Artificial
  Synthetic Luk764 LukAB binding FN3 domain
LPAPKNLVVSRVTEDSARLSWPINKTTSPFDSFLIQYQESEKVGEAIVLTVPGSERSYDLTGLKPGTEYTVSIYGVVEAHYDAFISNPLSAIFTT

SEQ ID NO: 644 - protein, 96 aa, Artificial
  Synthetic Luk765 LukAB binding FN3 domain
LPAPKNLVVSRVTEDSARLSWRKKLWEAEFDSFLIQYQESEKVGEAIVLTVPGSERSYDLTGLKPGTEYTVSIYGVILPDSFHVHHCNPLSAIFTT

SEQ ID NO: 645 - protein, 95 aa, Artificial
  Synthetic Luk766 LukAB binding FN3 domain
LPAPKNLVVSRVTEDSARLSWKRPQWRRLFDSFLIQYQESEKVGEAIVLTVPGSERSYDLTGLKPGTEYTVSIYGVGVNWPASVSSNPLSAIFTT

SEQ ID NO: 646 - protein, 95 aa, Artificial
  Synthetic Luk767 LukAB binding FN3 domain
LPAPKNLVVSRVTEDSARLSWIWDAIGPHFFDSFLIQYQESEKVGEAIVLTVPGSERSYDLTGLKPGTEYTVSIYGVSWFIRITASNPLSAIFTT

SEQ ID NO: 647 - protein, 98 aa, Artificial
  Synthetic Luk768 LukAB binding FN3 domain
LPAPKNLVVSRVTEDSARLSWRGLEPRWGFDSFLIQYQESEKVGEAIVLTVPGSERSYDLTGLKPGTEYTVSIYGVPWYEHLRILNATSNPLSAIFTT

SEQ ID NO: 648 - protein, 97 aa, Artificial
  Synthetic Luk769 LukAB binding FN3 domain
LPAPKNLVVSRVTEDSARLSWDWWSNPIKFDSFLIQYQESEKVGEAIVLTVPGSERSYDLTGLKPGTEYTVSIYGVINWHWYQTHRTSNPLSAIFTT

SEQ ID NO: 649 - protein, 99 aa, Artificial
  Synthetic Luk770 LukAB binding FN3 domain
LPAPKNLVVSRVTEDSARLSWEQWHAGVNPFDSFLIQYQESEKVGEAIVLTVPGSERSYDLTGLKPGTEYTVSIYGVSYYVRVLQFALFSNPLSAIFTT

SEQ ID NO: 650 - protein, 96 aa, Artificial
  Synthetic Luk771 LukAB binding FN3 domain
LPAPKNLVVSRVTEDSARLSWAQVETQIHFDSFLIQYQESEKVGESDLLTVPGSERSYDLTGLKPGTEYTVSIYGVSHYRRHVPRHSNPLSAIFTT

SEQ ID NO: 651 - protein, 97 aa, Artificial
  Synthetic Luk772 LukAB binding FN3 domain
LPAPKNLVVSRVTEDSARLSWIAYYYGQTFDSFLIQYQESEKVGEAIVLTVPGSERSYDLTGLKPGTEYTVSIYGVWHENYAKWPDPSNPLSAIFTT

SEQ ID NO: 652 - protein, 98 aa, Artificial
  Synthetic Luk773 LukAB binding FN3 domain
LPAPKNLVVSRVTEDSARLSWWHWLTHHFFDSFLIQYQESEKVGEAIVLTVPGSERSYDLTGLKPGTEYTVSIYGVFFRWQDPLHDLISNPLSAIFTT

SEQ ID NO: 653 - protein, 94 aa, Artificial
  Synthetic Luk774 LukAB binding FN3 domain
LPAPKNLVVSRVTEDSARLSWKYKEHFQIFDSFLIQYQESEKVGEAIVLTVPGSERSYDLTGLKPGTEYTVSIYGVERIWWQYRSNPLSAIFTT

SEQ ID NO: 654 - protein, 95 aa, Artificial
  Synthetic Luk775 LukAB binding FN3 domain
LPAPKNLVVSRVTEDSARLSWVGDAYFNHLFDSFLIQYQESEKVGEAIVLTVPGSERSYDLTGLKPGTEYTVSIYGVEARPKPRLSNPLSAIFTT

SEQ ID NO: 655 - protein, 92 aa, Artificial
  Synthetic Luk776 LukAB binding FN3 domain
LPAPKNLVVSRVTEDSARLSWNKRVPNFDSFLIQYQESEKVGEAIVLTVPGSERSYDLTGLKPGTEYTVSIYGVIQWKKKPFSNPLSAIFTT

SEQ ID NO: 656 - protein, 97 aa, Artificial
  Synthetic Luk777 LukAB binding FN3 domain
LPAPKNLVVSRVTEDSARLSWYNEQKKRSFFDSFLIQYQESEKVGEAIVLTVPGSERSYDLTGLKPGTEYTVSIYGVPIRRSGWDVRSNPLSAIFTT

SEQ ID NO: 657 - protein, 96 aa, Artificial
  Synthetic Luk778 LukAB binding FN3 domain
LPAPKNLVVSRVTEDSARLSWYNTKKKPVFDSFLIQYQESEKVGEAIVLTVPGSERSYDLTGLKPGTEYTVSIYGVKVDDWPDYWQSNPLSAIFTT

SEQ ID NO: 658 - protein, 96 aa, Artificial
  Synthetic Luk779 LukAB binding FN3 domain
LPAPKNLVVSRVTEDSARLSWYNVKKTFQFDSFLIQYQESEKVGEAIVLTVPGSERSYDLTGLKPGTEYTVSIYGVAAVWYTPNTQSNPLSAIFTT

SEQ ID NO: 659 - protein, 97 aa, Artificial
  Synthetic Luk780 LukAB binding FN3 domain
LPAPKNLVVSRVTEDSARLSWYNSKKKVQFDSFLIQYQESEKVGEAIVLTVPGSERSYDLTGLKPGTEYTVSIYGVIESHWWQLKWPSNPLSAIFTT

SEQ ID NO: 660 - protein, 97 aa, Artificial
  Synthetic Luk781 LukAB binding FN3 domain
LPAPKNLVVSRVTEDSARLSWYNTKKKTAFFDSFLIQYQESEKVGEAIVLTVPGSERSYDLTGLKPGTEYTVSIYGVDEVGYLHIETSNPLSAIFTT

SEQ ID NO: 661 - protein, 98 aa, Artificial
  Synthetic Luk782 LukAB binding FN3 domain
LPAPKNLVVSRVTEDSARLSWYNEKKIFQFDSFLIQYQESEKVGEAIVLTVPGSERSYDLTGLKPGTEYTVSIYGAKGPNFPSQNDPSSNPLSAIFTT

SEQ ID NO: 662 - protein, 98 aa, Artificial
  Synthetic Luk783 LukAB binding FN3 domain
LPAPKNLVVSRVTEDSARLSWYNWKKKRLKFDSFLIQYQESEKVGEAIVLTVPGSERSYDLTGLKPGTEYTVSIYGVASPVYTGLYLGSNPLSAIFTT

SEQ ID NO: 663 - protein, 98 aa, Artificial
  Synthetic Luk784 LukAB binding FN3 domain
LPAPKNLVVSRVTEDSARLSWYTVKKKPQKFDSFLIQYQESEKVGEAIVLTVPGSERSYDLTGLKPGTEYTVSIYGVGDQLLEIGRTGSNPLSAIFTT

SEQ ID NO: 664 - protein, 89 aa, Artificial
  Synthetic Luk785 LukAB binding FN3 domain
LPAPKNLVVSRVTEDSARLSWTAPDAAFDSFFIGYREVPFLGEAIVLTVPGSERSYDLTGLKPGTEYIVLIWGVKGGIPSQPLSAIFTT

SEQ ID NO: 665 - protein, 89 aa, Artificial
  Synthetic Luk786 LukAB binding FN3 domain
LPAPKNLVVSRVTEDSARLSWTAPDAAFDSFFIPYREEAPLGEAIVLTVPGSERSYDLTGLKPGTEYDVIIVGVKGGYPSKPLSAIFTT

SEQ ID NO: 666 - protein, 89 aa, Artificial
  Synthetic Luk787 LukAB binding FN3 domain
LPAPKNLVVSRVTEDSARLSWTAPDAAFDSFWIVYHELVHSGEAIVLTVPGSERSYDLTGLKPGTEYPVFIVGVKGGWYSPPLSAIFTT

SEQ ID NO: 667 - protein, 89 aa, Artificial
  Synthetic TCL24
  misc_feature (32)..(32): Xaa can be any naturally occurring amino acid
  misc_feature (34)..(34): Xaa can be any naturally occurring amino acid
  misc_feature (36)..(36): Xaa can be any naturally occurring amino acid
  misc_feature (38)..(41): Xaa can be any naturally occurring amino acid
  misc_feature (46)..(46): Xaa can be any naturally occurring amino acid
  misc_feature (48)..(48): Xaa can be any naturally occurring amino acid
  misc_feature (68)..(68): Xaa can be any naturally occurring amino acid
  misc_feature (70)..(70): Xaa can be any naturally occurring amino acid
  misc_feature (72)..(72): Xaa can be any naturally occurring amino acid
  misc_feature (78)..(79): Xaa can be any naturally occurring amino acid
  misc_feature (81)..(81): Xaa can be any naturally occurring amino acid
  misc_feature (84)..(84): Xaa can be any naturally occurring amino acid
  misc_feature (86)..(86): Xaa can be any naturally occurring amino acid
LPAPKNLVVSRVTEDSARLSWTAPDAAFDSFXIXYXEXXXXGEAIXLXVPGSERSYDLTGLKPGTEYXVXIXGVKGGXXSXPLXAXFTT

SEQ ID NO: 668 - protein, 872 aa, S. aureus
GSMASENSVTQSDSASNESKSNDSSSVSAAPKTDDTNVSDTKTSSNTNNGETSVAQNPAQQETTQSSSTNATTEETPVTGEATTTTTNQANTPATTQSSNTNAEELVNQTSNETTFNDTNTVSSVNSPQNSTNAENVSTTQDTSTEATPSNNESAPQSTDASNKDVVNQAVNTSAPRMRAFSLAAVAADAPAAGTDITNQLTNVTVGIDSGTTVYPHQAGYVKLNYGFSVPNSAVKGDTFKITVPKELNLNGVTSTAKVPPIMAGDQVLANGVIDSDGNVIYTFTDYVNTKDDVKATLTMPAYIDPENVKKTGNVTLATGIGSTTANKTVLVDYEKYGKFYNLSIKGTIDQIDKTNNTYRQTIYVNPSGDNVIAPVLTGNLKPNTDSNALIDQQNTSIKVYKVDNAADLSESYFVNPENFEDVTNSVNITFPNPNQYKVEFNTPDDQITTPYIVVVNGHIDPNSKGDLALRSTLYGYNSNIIWRSMSWDNEVAFNNGSGSGDGIDKPVVPEQPDEPGEIEPIPEDSDSDPGSDSGSDSNSDSGSDSGSDSTSDSGSDSASDSDSASDSDSASDSDSASDSDSASDSDSDNDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSASDSDSDSDSDSDSDSDSDSDSDSDSDSDSDSDSDSDSDSESDSDSESDSDSDSDSDSDSDSDSDSDSDSASDSDSGSDSDSSSDSDSESDSNSDSESGSNNNVVPPNSPKNGTNASNKNEAKDSKEPLPDTLEHHHHHH

SEQ ID NO: 669 - protein, 845 aa, S. aureus
GSMASEQSNDTTQSSKNNASADSEKNNMIETPQLNTTANDTSDISANTNSANVDSTTKPMSTQTSNTTTTEPASTNETPQPTAIKNQATAAKMQDQTVPQEANSQVDNKTTNDANSIATNSELKNSQTLDLPQSSPQTISNAQGTSKPSVRTRAVRSLAVAEPVVNAADAKGTNVNDKVTASNFKLEKTTFDPNQSGNTFMAANFTVTDKVKSGDYFTAKLPDSLTGNGDVDYSNSNNTMPIADIKSTNGDVVAKATYDILTKTYTFVFTDYVNNKENINGQFSLPLFTDRAKAPKSGTYDANINIADEMFNNKITYNYSSPIAGIDKPNGANISSQIIGVDTASGQNTYKQTVFVNPKQRVLGNTWVYIKGYQDKIEESSGKVSATDTKLRIFEVNDTSKLSDSYYADPNDSNLKEVTDQFKNRIYYEHPNVASIKFGDITKTYVVLVEGHYDNTGKNLKTQVIQENVDPVTNRDYSIFGWNNENVVRYGGGSADGDSAVNPKDPTPGPPVDPEPSPDPEPEPTPDPEPSPDPEPEPSPDPDPDSDSDSDSGSDSDSGSDSDSESDSDSDSDSDSDSDSDSESDSDSESDSDSDSDSDSDSDSDSDSDSDSDSDSDSDSDSDSESDSDSESDSESDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSRVTPPNNEQKAPSNPKGEVNHSNKVSKQHKTDALPETLEHHHHHH

SEQ ID NO: 670 - protein, 28 aa, Artificial
  Synthetic SD peptide
SDSDSDSDSDSDSDSDSDSDHHHHHHHH

SEQ ID NO: 671 - protein, 332 aa, S. aureus
NSAHHHHHHGSHKDSQDQNKKEHVDKSQQKDKRNVTNKDKNSTAPDDIGKNGKITKRTETVYDEKTNILQNLQFDFIDDPTYDKNVLLVKKQGSIHSNLKFESHKEEKNSNWLKYPSEYHVDFQVKRNRKTEILDQLPKNKISTAKVDSTFSYSSGGKFDSTKGIGRTSSNSYSKTISYNQQNYDTIASGKNNNWHVHWSVIANDLKYGGEVKNRNDELLFYRNTRIATVENPELSFASKYRYPALVRSGFNPEFLTYLSNEKSNEKTQFEVTYTRNQDILKNRPGIHYAPPILEKNKDGQRLIVTYEVDWKNKTVKVVDKYSDDNKPYKEG

SEQ ID NO: 672 - protein, 89 aa, Artificial
  Synthetic Luk17W32A
LPAPKNLVVSRVTEDSARLSWTAPDAAFDSFAITYEEKFYRGEAIVLTVPGSERSYDLTGLKPGTEYKVWIVGVKGGQGSWPLSAIFTT

SEQ ID NO: 673 - protein, 89 aa, Artificial
  Synthetic Luk17T34A
LPAPKNLVVSRVTEDSARLSWTAPDAAFDSFWIAYEEKFYRGEAIVLTVPGSERSYDLTGLKPGTEYKVWIVGVKGGQGSWPLSAIFTT

SEQ ID NO: 674 - protein, 89 aa, Artificial
  Synthetic Luk17E36A
LPAPKNLVVSRVTEDSARLSWTAPDAAFDSFWITYAEKFYRGEAIVLTVPGSERSYDLTGLKPGTEYKVWIVGVKGGQGSWPLSAIFTT

SEQ ID NO: 675 - protein, 89 aa, Artificial
  Synthetic Luk17K38A
LPAPKNLVVSRVTEDSARLSWTAPDAAFDSFWITYEEAFYRGEAIVLTVPGSERSYDLTGLKPGTEYKVWIVGVKGGQGSWPLSAIFTT

SEQ ID NO: 676 - protein, 89 aa, Artificial
  Synthetic Luk17F39A
LPAPKNLVVSRVTEDSARLSWTAPDAAFDSFWITYEEKAYRGEAIVLTVPGSERSYDLTGLKPGTEYKVWIVGVKGGQGSWPLSAIFTT

SEQ ID NO: 677 - protein, 89 aa, Artificial
  Synthetic Luk17Y40A
LPAPKNLVVSRVTEDSARLSWTAPDAAFDSFWITYEEKFARGEAIVLTVPGSERSYDLTGLKPGTEYKVWIVGVKGGQGSWPLSAIFTT

SEQ ID NO: 678 - protein, 89 aa, Artificial
  Synthetic Luk17R41A
LPAPKNLVVSRVTEDSARLSWTAPDAAFDSFWITYEEKFYAGEAIVLTVPGSERSYDLTGLKPGTEYKVWIVGVKGGQGSWPLSAIFTT

SEQ ID NO: 679 - protein, 89 aa, Artificial
  Synthetic Luk17K68A
LPAPKNLVVSRVTEDSARLSWTAPDAAFDSFWITYEEKFYRGEAIVLTVPGSERSYDLTGLKPGTEYAVWIVGVKGGQGSWPLSAIFTT

SEQ ID NO: 680 - protein, 89 aa, Artificial
  Synthetic Luk17W70A
LPAPKNLVVSRVTEDSARLSWTAPDAAFDSFWITYEEKFYRGEAIVLTVPGSERSYDLTGLKPGTEYKVAIVGVKGGQGSWPLSAIFTT

SEQ ID NO: 681 - protein, 89 aa, Artificial
  Synthetic Luk17V72A
LPAPKNLVVSRVTEDSARLSWTAPDAAFDSFWITYEEKFYRGEAIVLTVPGSERSYDLTGLKPGTEYKVWIAGVKGGQGSWPLSAIFTT

SEQ ID NO: 682 - protein, 89 aa, Artificial
  Synthetic Luk17Q78A
LPAPKNLVVSRVTEDSARLSWTAPDAAFDSFWITYEEKFYRGEAIVLTVPGSERSYDLTGLKPGTEYKVWIVGVKGGAGSWPLSAIFTT

SEQ ID NO: 683 - protein, 89 aa, Artificial
  Synthetic Luk17G79A
LPAPKNLVVSRVTEDSARLSWTAPDAAFDSFWITYEEKFYRGEAIVLTVPGSERSYDLTGLKPGTEYKVWIVGVKGGQASWPLSAIFTT

SEQ ID NO: 684 - protein, 89 aa, Artificial
  Synthetic Luk17W81A
LPAPKNLVVSRVTEDSARLSWTAPDAAFDSFWITYEEKFYRGEAIVLTVPGSERSYDLTGLKPGTEYKVWIVGVKGGQGSAPLSAIFTT

SEQ ID NO: 685 - protein, 89 aa, Artificial
  Synthetic Luk17G42A
LPAPKNLVVSRVTEDSARLSWTAPDAAFDSFWITYEEKFYRAEAIVLTVPGSERSYDLTGLKPGTEYKVWIVGVKGGQGSWPLSAIFTT

SEQ ID NO: 686 - protein, 89 aa, Artificial
  Synthetic Luk17V46A
LPAPKNLVVSRVTEDSARLSWTAPDAAFDSFWITYEEKFYRGEAIALTVPGSERSYDLTGLKPGTEYKVWIVGVKGGQGSWPLSAIFTT

SEQ ID NO: 687 - protein, 89 aa, Artificial
  Synthetic Luk17E66A
LPAPKNLVVSRVTEDSARLSWTAPDAAFDSFWITYEEKFYRGEAIVLTVPGSERSYDLTGLKPGTAYKVWIVGVKGGQGSWPLSAIFTT

SEQ ID NO: 688 - protein, 89 aa, Artificial
  Synthetic Luk17G77A
LPAPKNLVVSRVTEDSARLSWTAPDAAFDSFWITYEEKFYRGEAIVLTVPGSERSYDLTGLKPGTEYKVWIVGVKGAQGSWPLSAIFTT

SEQ ID NO: 689 - protein, 89 aa, Artificial
  Synthetic Luk17P82A
LPAPKNLVVSRVTEDSARLSWTAPDAAFDSFWITYEEKFYRGEAIVLTVPGSERSYDLTGLKPGTEYKVWIVGVKGGQGSWALSAIFTT

SEQ ID NO: 690 - protein, 89 aa, Artificial
  Synthetic Luk17S84A
LPAPKNLVVSRVTEDSARLSWTAPDAAFDSFWITYEEKFYRGEAIVLTVPGSERSYDLTGLKPGTEYKVWIVGVKGGQGSWPLAAIFTT

SEQ ID NO: 691 - protein, 89 aa, Artificial
  Synthetic Luk17I86A
LPAPKNLVVSRVTEDSARLSWTAPDAAFDSFWITYEEKFYRGEAIVLTVPGSERSYDLTGLKPGTEYKVWIVGVKGGQGSWPLSAAFTT

SEQ ID NO: 692 - protein, 89 aa, Artificial
  Synthetic Luk17W32S
LPAPKNLVVSRVTEDSARLSWTAPDAAFDSFSITYEEKFYRGEAIVLTVPGSERSYDLTGLKPGTEYKVWIVGVKGGQGSWPLSAIFTT

SEQ ID NO: 693 - protein, 89 aa, Artificial
  Synthetic Luk17T34S
LPAPKNLVVSRVTEDSARLSWTAPDAAFDSFWISYEEKFYRGEAIVLTVPGSERSYDLTGLKPGTEYKVWIVGVKGGQGSWPLSAIFTT

SEQ ID NO: 694 - protein, 89 aa, Artificial
  Synthetic Luk17E36S
LPAPKNLVVSRVTEDSARLSWTAPDAAFDSFWITYSEKFYRGEAIVLTVPGSERSYDLTGLKPGTEYKVWIVGVKGGQGSWPLSAIFTT

SEQ ID NO: 695 - protein, 89 aa, Artificial
  Synthetic Luk17K38S
LPAPKNLVVSRVTEDSARLSWTAPDAAFDSFWITYEESFYRGEAIVLTVPGSERSYDLTGLKPGTEYKVWIVGVKGGQGSWPLSAIFTT

SEQ ID NO: 696 - protein, 89 aa, Artificial
  Synthetic Luk17F39S
LPAPKNLVVSRVTEDSARLSWTAPDAAFDSFWITYEEKSYRGEAIVLTVPGSERSYDLTGLKPGTEYKVWIVGVKGGQGSWPLSAIFTT

SEQ ID NO: 697 - protein, 89 aa, Artificial
  Synthetic Luk17Y40S
LPAPKNLVVSRVTEDSARLSWTAPDAAFDSFWITYEEKFSRGEAIVLTVPGSERSYDLTGLKPGTEYKVWIVGVKGGQGSWPLSAIFTT

SEQ ID NO: 698 - protein, 89 aa, Artificial
  Synthetic Luk17R41S
LPAPKNLVVSRVTEDSARLSWTAPDAAFDSFWITYEEKFYSGEAIVLTVPGSERSYDLTGLKPGTEYKVWIVGVKGGQGSWPLSAIFTT

SEQ ID NO: 699 - protein, 89 aa, Artificial
  Synthetic Luk17K68S
LPAPKNLVVSRVTEDSARLSWTAPDAAFDSFWITYEEKFYRGEAIVLTVPGSERSYDLTGLKPGTEYSVWIVGVKGGQGSWPLSAIFTT

SEQ ID NO: 700 - protein, 89 aa, Artificial
  Synthetic Luk17W70S
LPAPKNLVVSRVTEDSARLSWTAPDAAFDSFWITYEEKFYRGEAIVLTVPGSERSYDLTGLKPGTEYKVSIVGVKGGQGSWPLSAIFTT

SEQ ID NO: 701 - protein, 89 aa, Artificial
  Synthetic Luk17V72S
LPAPKNLVVSRVTEDSARLSWTAPDAAFDSFWITYEEKFYRGEAIVLTVPGSERSYDLTGLKPGTEYKVWISGVKGGQGSWPLSAIFTT

SEQ ID NO: 702 - protein, 89 aa, Artificial
  Synthetic Luk17Q78S
LPAPKNLVVSRVTEDSARLSWTAPDAAFDSFWITYEEKFYRGEAIVLTVPGSERSYDLTGLKPGTEYKVWIVGVKGGSGSWPLSAIFTT

SEQ ID NO: 703 - protein, 89 aa, Artificial
  Synthetic Luk17G79S
LPAPKNLVVSRVTEDSARLSWTAPDAAFDSFWITYEEKFYRGEAIVLTVPGSERSYDLTGLKPGTEYKVWIVGVKGGQSSWPLSAIFTT

SEQ ID NO: 704 - protein, 89 aa, Artificial
  Synthetic Luk17W81S
LPAPKNLVVSRVTEDSARLSWTAPDAAFDSFWITYEEKFYRGEAIVLTVPGSERSYDLTGLKPGTEYKVWIVGVKGGQGSSPLSAIFTT

SEQ ID NO: 705 - protein, 89 aa, Artificial
  Synthetic Luk17G42S
LPAPKNLVVSRVTEDSARLSWTAPDAAFDSFWITYEEKFYRSEAIVLTVPGSERSYDLTGLKPGTEYKVWIVGVKGGQGSWPLSAIFTT

SEQ ID NO: 706 - protein, 89 aa, Artificial
  Synthetic Luk17A44S
LPAPKNLVVSRVTEDSARLSWTAPDAAFDSFWITYEEKFYRGESIVLTVPGSERSYDLTGLKPGTEYKVWIVGVKGGQGSWPLSAIFTT

SEQ ID NO: 707 - protein, 89 aa, Artificial
  Synthetic Luk17V46S
LPAPKNLVVSRVTEDSARLSWTAPDAAFDSFWITYEEKFYRGEAISLTVPGSERSYDLTGLKPGTEYKVWIVGVKGGQGSWPLSAIFTT

SEQ ID NO: 708 - protein, 89 aa, Artificial
  Synthetic Luk17E66S
LPAPKNLVVSRVTEDSARLSWTAPDAAFDSFWITYEEKFYRGEAIVLTVPGSERSYDLTGLKPGTSYKVWIVGVKGGQGSWPLSAIFTT

SEQ ID NO: 709 - protein, 89 aa, Artificial
  Synthetic Luk17G77S
LPAPKNLVVSRVTEDSARLSWTAPDAAFDSFWITYEEKFYRGEAIVLTVPGSERSYDLTGLKPGTEYKVWIVGVKGSQGSWPLSAIFTT

SEQ ID NO: 710 - protein, 89 aa, Artificial
  Synthetic Luk17P82S
LPAPKNLVVSRVTEDSARLSWTAPDAAFDSFWITYEEKFYRGEAIVLTVPGSERSYDLTGLKPGTEYKVWIVGVKGGQGSWSLSAIFTT

SEQ ID NO: 711 - protein, 89 aa, Artificial; identical to SEQ ID NO: 14
  Synthetic Luk17S84S

SEQ ID NO: 712 - protein, 89 aa, Artificial
  Synthetic Luk17I86S
LPAPKNLVVSRVTEDSARLSWTAPDAAFDSFWITYEEKFYRGEAIVLTVPGSERSYDLTGLKPGTEYKVWIVGVKGGQGSWPLSASFTT

SEQ ID NO: 713 - protein, 89 aa, Artificial
  Synthetic Luk17W32L
LPAPKNLVVSRVTEDSARLSWTAPDAAFDSFLITYEEKFYRGEAIVLTVPGSERSYDLTGLKPGTEYKVWIVGVKGGQGSWPLSAIFTT

SEQ ID NO: 714 - protein, 89 aa, Artificial
  Synthetic Luk17T34Q
LPAPKNLVVSRVTEDSARLSWTAPDAAFDSFWIQYEEKFYRGEAIVLTVPGSERSYDLTGLKPGTEYKVWIVGVKGGQGSWPLSAIFTT

SEQ ID NO: 715 - protein, 89 aa, Artificial
  Synthetic Luk17E36Q
LPAPKNLVVSRVTEDSARLSWTAPDAAFDSFWITYQEKFYRGEAIVLTVPGSERSYDLTGLKPGTEYKVWIVGVKGGQGSWPLSAIFTT

SEQ ID NO: 716 - protein, 89 aa, Artificial
  Synthetic Luk17F39E
LPAPKNLVVSRVTEDSARLSWTAPDAAFDSFWITYEEKEYRGEAIVLTVPGSERSYDLTGLKPGTEYKVWIVGVKGGQGSWPLSAIFTT

SEQ ID NO: 717 - protein, 89 aa, Artificial
  Synthetic Luk17Y40K
LPAPKNLVVSRVTEDSARLSWTAPDAAFDSFWITYEEKFKRGEAIVLTVPGSERSYDLTGLKPGTEYKVWIVGVKGGQGSWPLSAIFTT

SEQ ID NO: 718 - protein, 89 aa, Artificial
  Synthetic Luk17R41V
LPAPKNLVVSRVTEDSARLSWTAPDAAFDSFWITYEEKFYVGEAIVLTVPGSERSYDLTGLKPGTEYKVWIVGVKGGQGSWPLSAIFTT

SEQ ID NO: 719 - protein, 89 aa, Artificial
  Synthetic Luk17K68T
LPAPKNLVVSRVTEDSARLSWTAPDAAFDSFWITYEEKFYRGEAIVLTVPGSERSYDLTGLKPGTEYTVWIVGVKGGQGSWPLSAIFTT

SEQ ID NO: 720 - protein, 89 aa, Artificial
  Synthetic Luk17V72Y
LPAPKNLVVSRVTEDSARLSWTAPDAAFDSFWITYEEKFYRGEAIVLTVPGSERSYDLTGLKPGTEYKVWIYGVKGGQGSWPLSAIFTT

SEQ ID NO: 721 - protein, 89 aa, Artificial
  Synthetic Luk17Q78H
LPAPKNLVVSRVTEDSARLSWTAPDAAFDSFWITYEEKFYRGEAIVLTVPGSERSYDLTGLKPGTEYKVWIVGVKGGHGSWPLSAIFTT

SEQ ID NO: 722 - protein, 89 aa, Artificial
  Synthetic Luk17G79R
LPAPKNLVVSRVTEDSARLSWTAPDAAFDSFWITYEEKFYRGEAIVLTVPGSERSYDLTGLKPGTEYKVWIVGVKGGQRSWPLSAIFTT

SEQ ID NO: 723 - protein, 89 aa, Artificial
  Synthetic Luk17W81N
LPAPKNLVVSRVTEDSARLSWTAPDAAFDSFWITYEEKFYRGEAIVLTVPGSERSYDLTGLKPGTEYKVWIVGVKGGQGSNPLSAIFTT

SEQ ID NO: 724 - protein, 89 aa, Artificial
  Synthetic Luk17wtFG
LPAPKNLVVSRVTEDSARLSWTAPDAAFDSFWITYEEKFYRGEAIVLTVPGSERSYDLTGLKPGTEYKVWIVGVKGGHRSNPLSAIFTT

SEQ ID NO: 725 - protein, 96 aa, Artificial
  Synthetic Luk17S38FG
LPAPKNLVVSRVTEDSARLSWTAPDAAFDSFWITYEEKFYRGEAIVLTVPGSERSYDLTGLKPGTEYKVWIVGVELIYHGWLDFVFSNPLSAIFTT

SEQ ID NO: 726 - protein, 89 aa, Artificial
  Synthetic Luk17W32D
LPAPKNLVVSRVTEDSARLSWTAPDAAFDSFDITYEEKFYRGEAIVLTVPGSERSYDLTGLKPGTEYKVWIVGVKGGQGSWPLSAIFTT

SEQ ID NO: 727 - protein, 89 aa, Artificial
  Synthetic Luk17W32T
LPAPKNLVVSRVTEDSARLSWTAPDAAFDSFTITYEEKFYRGEAIVLTVPGSERSYDLTGLKPGTEYKVWIVGVKGGQGSWPLSAIFTT

SEQ ID NO: 728 - protein, 89 aa, Artificial
  Synthetic Luk17W32Q
LPAPKNLVVSRVTEDSARLSWTAPDAAFDSFQITYEEKFYRGEAIVLTVPGSERSYDLTGLKPGTEYKVWIVGVKGGQGSWPLSAIFTT

SEQ ID NO: 729 - protein, 89 aa, Artificial
  Synthetic Luk17W81D
LPAPKNLVVSRVTEDSARLSWTAPDAAFDSFWITYEEKFYRGEAIVLTVPGSERSYDLTGLKPGTEYKVWIVGVKGGQGSDPLSAIFTT

SEQ ID NO: 730 - protein, 89 aa, Artificial
  Synthetic Luk17W81L
LPAPKNLVVSRVTEDSARLSWTAPDAAFDSFWITYEEKFYRGEAIVLTVPGSERSYDLTGLKPGTEYKVWIVGVKGGQGSLPLSAIFTT

SEQ ID NO: 731 - protein, 89 aa, Artificial
  Synthetic Luk17W81T
LPAPKNLVVSRVTEDSARLSWTAPDAAFDSFWITYEEKFYRGEAIVLTVPGSERSYDLTGLKPGTEYKVWIVGVKGGQGSTPLSAIFTT

SEQ ID NO: 732 - protein, 89 aa, Artificial
  Synthetic Luk17W81Q
LPAPKNLVVSRVTEDSARLSWTAPDAAFDSFWITYEEKFYRGEAIVLTVPGSERSYDLTGLKPGTEYKVWIVGVKGGQGSQPLSAIFTT

SEQ ID NO: 733 - protein, 89 aa, Artificial
  Synthetic Luk17W32LW81S
LPAPKNLVVSRVTEDSARLSWTAPDAAFDSFLITYEEKFYRGEAIVLTVPGSERSYDLTGLKPGTEYKVWIVGVKGGQGSSPLSAIFTT

SEQ ID NO: 734 - protein, 89 aa, Artificial
  Synthetic Luk17W32TW81S
LPAPKNLVVSRVTEDSARLSWTAPDAAFDSFTITYEEKFYRGEAIVLTVPGSERSYDLTGLKPGTEYKVWIVGVKGGQGSSPLSAIFTT

SEQ ID NO: 735 - protein, 89 aa, Artificial
  Synthetic Luk17W32SW81S
LPAPKNLVVSRVTEDSARLSWTAPDAAFDSFSITYEEKFYRGEAIVLTVPGSERSYDLTGLKPGTEYKVWIVGVKGGQGSSPLSAIFTT

SEQ ID NO: 736 - protein, 89 aa, Artificial
  Synthetic Luk17W32DW81D
LPAPKNLVVSRVTEDSARLSWTAPDAAFDSFDITYEEKFYRGEAIVLTVPGSERSYDLTGLKPGTEYKVWIVGVKGGQGSDPLSAIFTT

SEQ ID NO: 737 - protein, 89 aa, Artificial
  Synthetic Luk17W32TW81T
LPAPKNLVVSRVTEDSARLSWTAPDAAFDSFTITYEEKFYRGEAIVLTVPGSERSYDLTGLKPGTEYKVWIVGVKGGQGSTPLSAIFTT

SEQ ID NO: 738 - protein, 89 aa, Artificial
  Synthetic Luk17W32QW81Q
LPAPKNLVVSRVTEDSARLSWTAPDAAFDSFQITYEEKFYRGEAIVLTVPGSERSYDLTGLKPGTEYKVWIVGVKGGQGSQPLSAIFTT

SEQ ID NO: 739 - protein, 89 aa, Artificial
  Synthetic Luk26H32A
LPAPKNLVVSRVTEDSARLSWTAPDAAFDSFAIEYAEPWVWGEAIVLTVPGSERSYDLTGLKPGTEYVVFIGGVKGGHNSTPLSAIFTT

SEQ ID NO: 740 - protein, 89 aa, Artificial
  Synthetic Luk26E34A
LPAPKNLVVSRVTEDSARLSWTAPDAAFDSFHIAYAEPWVWGEAIVLTVPGSERSYDLTGLKPGTEYVVFIGGVKGGHNSTPLSAIFTT

SEQ ID NO: 741 - protein, 89 aa, Artificial
  Synthetic Luk26A36S
LPAPKNLVVSRVTEDSARLSWTAPDAAFDSFHIEYSEPWVWGEAIVLTVPGSERSYDLTGLKPGTEYVVFIGGVKGGHNSTPLSAIFTT

SEQ ID NO: 742 - protein, 89 aa, Artificial
  Synthetic Luk26P38A
LPAPKNLVVSRVTEDSARLSWTAPDAAFDSFHIEYAEAWVWGEAIVLTVPGSERSYDLTGLKPGTEYVVFIGGVKGGHNSTPLSAIFTT

SEQ ID NO: 743 - protein, 89 aa, Artificial
  Synthetic Luk26W39A
LPAPKNLVVSRVTEDSARLSWTAPDAAFDSFHIEYAEPAVWGEAIVLTVPGSERSYDLTGLKPGTEYVVFIGGVKGGHNSTPLSAIFTT

SEQ ID NO: 744 - protein, 89 aa, Artificial
  Synthetic Luk26V40A
LPAPKNLVVSRVTEDSARLSWTAPDAAFDSFHIEYAEPWAWGEAIVLTVPGSERSYDLTGLKPGTEYVVFIGGVKGGHNSTPLSAIFTT

SEQ ID NO: 745 - protein, 89 aa, Artificial
  Synthetic Luk26W41A
LPAPKNLVVSRVTEDSARLSWTAPDAAFDSFHIEYAEPWVAGEAIVLTVPGSERSYDLTGLKPGTEYVVFIGGVKGGHNSTPLSAIFTT

SEQ ID NO: 746 - protein, 89 aa, Artificial
  Synthetic Luk26V68A
LPAPKNLVVSRVTEDSARLSWTAPDAAFDSFHIEYAEPWVWGEAIVLTVPGSERSYDLTGLKPGTEYAVFIGGVKGGHNSTPLSAIFTT

SEQ ID NO: 747 - protein, 89 aa, Artificial
  Synthetic Luk26F70A
LPAPKNLVVSRVTEDSARLSWTAPDAAFDSFHIEYAEPWVWGEAIVLTVPGSERSYDLTGLKPGTEYVVAIGGVKGGHNSTPLSAIFTT

SEQ ID NO: 748 - protein, 89 aa, Artificial
  Synthetic Luk26G72A
LPAPKNLVVSRVTEDSARLSWTAPDAAFDSFHIEYAEPWVWGEAIVLTVPGSERSYDLTGLKPGTEYVVFIAGVKGGHNSTPLSAIFTT

SEQ ID NO: 749 - protein, 89 aa, Artificial
  Synthetic Luk26H78A
LPAPKNLVVSRVTEDSARLSWTAPDAAFDSFHIEYAEPWVWGEAIVLTVPGSERSYDLTGLKPGTEYVVFIGGVKGGANSTPLSAIFTT

SEQ ID NO: 750 - protein, 89 aa, Artificial
  Synthetic Luk26N79A
LPAPKNLVVSRVTEDSARLSWTAPDAAFDSFHIEYAEPWVWGEAIVLTVPGSERSYDLTGLKPGTEYVVFIGGVKGGHASTPLSAIFTT

SEQ ID NO: 751 - protein, 89 aa, Artificial
  Synthetic Luk26T81A
LPAPKNLVVSRVTEDSARLSWTAPDAAFDSFHIEYAEPWVWGEAIVLTVPGSERSYDLTGLKPGTEYVVFIGGVKGGHNSAPLSAIFTT

SEQ ID NO: 752 - protein, 89 aa, Artificial
  Synthetic Luk26G42A
LPAPKNLVVSRVTEDSARLSWTAPDAAFDSFHIEYAEPWVWAEAIVLTVPGSERSYDLTGLKPGTEYVVFIGGVKGGHNSTPLSAIFTT

SEQ ID NO: 753 - protein, 89 aa, Artificial
  Synthetic Luk26V46A
LPAPKNLVVSRVTEDSARLSWTAPDAAFDSFHIEYAEPWVWGEAIALTVPGSERSYDLTGLKPGTEYVVFIGGVKGGHNSTPLSAIFTT

SEQ ID NO: 754 - protein, 89 aa, Artificial
  Synthetic Luk26E66A
LPAPKNLVVSRVTEDSARLSWTAPDAAFDSFHIEYAEPWVWGEAIVLTVPGSERSYDLTGLKPGTAYVVFIGGVKGGHNSTPLSAIFTT

SEQ ID NO: 755 - protein, 89 aa, Artificial
  Synthetic Luk26G77A
LPAPKNLVVSRVTEDSARLSWTAPDAAFDSFHIEYAEPWVWGEAIVLTVPGSERSYDLTGLKPGTEYVVFIGGVKGAHNSTPLSAIFTT

SEQ ID NO: 756 - protein, 89 aa, Artificial
  Synthetic Luk26P82A
LPAPKNLVVSRVTEDSARLSWTAPDAAFDSFHIEYAEPWVWGEAIVLTVPGSERSYDLTGLKPGTEYVVFIGGVKGGHNSTALSAIFTT

SEQ ID NO: 757 - protein, 89 aa, Artificial
  Synthetic Luk26S84A
LPAPKNLVVSRVTEDSARLSWTAPDAAFDSFHIEYAEPWVWGEAIVLTVPGSERSYDLTGLKPGTEYVVFIGGVKGGHNSTPLAAIFTT

SEQ ID NO: 758 - protein, 89 aa, Artificial
  Synthetic Luk26I86A
LPAPKNLVVSRVTEDSARLSWTAPDAAFDSFHIEYAEPWVWGEAIVLTVPGSERSYDLTGLKPGTEYVVFIGGVKGGHNSTPLSAAFTT

SEQ ID NO: 759 - protein, 89 aa, Artificial
  Synthetic Luk26H32S
LPAPKNLVVSRVTEDSARLSWTAPDAAFDSFSIEYAEPWVWGEAIVLTVPGSERSYDLTGLKPGTEYVVFIGGVKGGHNSTPLSAIFTT

SEQ ID NO: 760 - protein, 89 aa, Artificial
  Synthetic Luk26E34S
LPAPKNLVVSRVTEDSARLSWTAPDAAFDSFHISYAEPWVWGEAIVLTVPGSERSYDLTGLKPGTEYVVFIGGVKGGHNSTPLSAIFTT

SEQ ID NO: 761 - protein, 89 aa, Artificial; identical to SEQ ID NO: 741
  Synthetic Luk26A36S

SEQ ID NO: 762 - protein, 89 aa, Artificial
  Synthetic Luk26P38S
LPAPKNLVVSRVTEDSARLSWTAPDAAFDSFHIEYAESWVWGEAIVLTVPGSERSYDLTGLKPGTEYVVFIGGVKGGHNSTPLSAIFTT

SEQ ID NO: 763 - protein, 89 aa, Artificial
  Synthetic Luk26W39S
LPAPKNLVVSRVTEDSARLSWTAPDAAFDSFHIEYAEPSVWGEAIVLTVPGSERSYDLTGLKPGTEYVVFIGGVKGGHNSTPLSAIFTT

SEQ ID NO: 764 - protein, 89 aa, Artificial
  Synthetic Luk26V40S
LPAPKNLVVSRVTEDSARLSWTAPDAAFDSFHIEYAEPWSWGEAIVLTVPGSERSYDLTGLKPGTEYVVFIGGVKGGHNSTPLSAIFTT

SEQ ID NO: 765 - protein, 89 aa, Artificial
  Synthetic Luk26W41S
LPAPKNLVVSRVTEDSARLSWTAPDAAFDSFHIEYAEPWVSGEAIVLTVPGSERSYDLTGLKPGTEYVVFIGGVKGGHNSTPLSAIFTT

SEQ ID NO: 766 - protein, 89 aa, Artificial
  Synthetic Luk26V68S
LPAPKNLVVSRVTEDSARLSWTAPDAAFDSFHIEYAEPWVWGEAIVLTVPGSERSYDLTGLKPGTEYSVFIGGVKGGHNSTPLSAIFTT

SEQ ID NO: 767 - protein, 89 aa, Artificial
  Synthetic Luk26F70S
LPAPKNLVVSRVTEDSARLSWTAPDAAFDSFHIEYAEPWVWGEAIVLTVPGSERSYDLTGLKPGTEYVVSIGGVKGGHNSTPLSAIFTT

SEQ ID NO: 768 - protein, 89 aa, Artificial
  Synthetic Luk26G72S
LPAPKNLVVSRVTEDSARLSWTAPDAAFDSFHIEYAEPWVWGEAIVLTVPGSERSYDLTGLKPGTEYVVFISGVKGGHNSTPLSAIFTT

SEQ ID NO: 769 - protein, 89 aa, Artificial
  Synthetic Luk26H78S
LPAPKNLVVSRVTEDSARLSWTAPDAAFDSFHIEYAEPWVWGEAIVLTVPGSERSYDLTGLKPGTEYVVFIGGVKGGSNSTPLSAIFTT

SEQ ID NO: 770 - protein, 89 aa, Artificial
  Synthetic Luk26N79S
LPAPKNLVVSRVTEDSARLSWTAPDAAFDSFHIEYAEPWVWGEAIVLTVPGSERSYDLTGLKPGTEYVVFIGGVKGGHSSTPLSAIFTT

SEQ ID NO: 771 - protein, 89 aa, Artificial
  Synthetic Luk26T81S
LPAPKNLVVSRVTEDSARLSWTAPDAAFDSFHIEYAEPWVWGEAIVLTVPGSERSYDLTGLKPGTEYVVFIGGVKGGHNSSPLSAIFTT

SEQ ID NO: 772 - protein, 89 aa, Artificial
  Synthetic Luk26G42S
LPAPKNLVVSRVTEDSARLSWTAPDAAFDSFHIEYAEPWVWSEAIVLTVPGSERSYDLTGLKPGTEYVVFIGGVKGGHNSTPLSAIFTT

SEQ ID NO: 773 - protein, 89 aa, Artificial
  Synthetic Luk26A44S
LPAPKNLVVSRVTEDSARLSWTAPDAAFDSFHIEYAEPWVWGESIVLTVPGSERSYDLTGLKPGTEYVVFIGGVKGGHNSTPLSAIFTT

SEQ ID NO: 774 - protein, 89 aa, Artificial
  Synthetic Luk26V46S
LPAPKNLVVSRVTEDSARLSWTAPDAAFDSFHIEYAEPWVWGEAISLTVPGSERSYDLTGLKPGTEYVVFIGGVKGGHNSTPLSAIFTT

SEQ ID NO: 775 - protein, 89 aa, Artificial
  Synthetic Luk26E66S
LPAPKNLVVSRVTEDSARLSWTAPDAAFDSFHIEYAEPWVWGEAIVLTVPGSERSYDLTGLKPGTSYVVFIGGVKGGHNSTPLSAIFTT

SEQ ID NO: 776 - protein, 89 aa, Artificial
  Synthetic Luk26G77S
LPAPKNLVVSRVTEDSARLSWTAPDAAFDSFHIEYAEPWVWGEAIVLTVPGSERSYDLTGLKPGTEYVVFIGGVKGSHNSTPLSAIFTT

SEQ ID NO: 777 - protein, 89 aa, Artificial
  Synthetic Luk26P82S
LPAPKNLVVSRVTEDSARLSWTAPDAAFDSFHIEYAEPWVWGEAIVLTVPGSERSYDLTGLKPGTEYVVFIGGVKGGHNSTSLSAIFTT

SEQ ID NO: 778 - protein, 89 aa, Artificial; identical to SEQ ID NO: 25
  Synthetic Luk26S84S

SEQ ID NO: 779 - protein, 89 aa, Artificial
  Synthetic Luk26I86S
LPAPKNLVVSRVTEDSARLSWTAPDAAFDSFHIEYAEPWVWGEAIVLTVPGSERSYDLTGLKPGTEYVVFIGGVKGGHNSTPLSASFTT

SEQ ID NO: 780 - protein, 89 aa, Artificial
  Synthetic Luk26H32L
LPAPKNLVVSRVTEDSARLSWTAPDAAFDSFLIEYAEPWVWGEAIVLTVPGSERSYDLTGLKPGTEYVVFIGGVKGGHNSTPLSAIFTT

SEQ ID NO: 781 - protein, 89 aa, Artificial
  Synthetic Luk26E34Q
LPAPKNLVVSRVTEDSARLSWTAPDAAFDSFHIQYAEPWVWGEAIVLTVPGSERSYDLTGLKPGTEYVVFIGGVKGGHNSTPLSAIFTT

SEQ ID NO: 782 - protein, 89 aa, Artificial
  Synthetic Luk26A36Q
LPAPKNLVVSRVTEDSARLSWTAPDAAFDSFHIEYQEPWVWGEAIVLTVPGSERSYDLTGLKPGTEYVVFIGGVKGGHNSTPLSAIFTT

SEQ ID NO: 783 - protein, 89 aa, Artificial
  Synthetic Luk26W39E
LPAPKNLVVSRVTEDSARLSWTAPDAAFDSFHIEYAEPEVWGEAIVLTVPGSERSYDLTGLKPGTEYVVFIGGVKGGHNSTPLSAIFTT

SEQ ID NO: 784 - protein, 89 aa, Artificial
  Synthetic Luk26V40K
LPAPKNLVVSRVTEDSARLSWTAPDAAFDSFHIEYAEPWKWGEAIVLTVPGSERSYDLTGLKPGTEYVVFIGGVKGGHNSTPLSAIFTT

SEQ ID NO: 785 - protein, 89 aa, Artificial
  Synthetic Luk26W41V
LPAPKNLVVSRVTEDSARLSWTAPDAAFDSFHIEYAEPWVVGEAIVLTVPGSERSYDLTGLKPGTEYVVFIGGVKGGHNSTPLSAIFTT

SEQ ID NO: 786 - protein, 89 aa, Artificial
  Synthetic Luk26V68T
LPAPKNLVVSRVTEDSARLSWTAPDAAFDSFHIEYAEPWVWGEAIVLTVPGSERSYDLTGLKPGTEYTVFIGGVKGGHNSTPLSAIFTT

SEQ ID NO: 787 - protein, 89 aa, Artificial
  Synthetic Luk26G72Y
LPAPKNLVVSRVTEDSARLSWTAPDAAFDSFHIEYAEPWVWGEAIVLTVPGSERSYDLTGLKPGTEYVVFIYGVKGGHNSTPLSAIFTT

SEQ ID NO: 788 - protein, 89 aa, Artificial
  Synthetic Luk26N79R
LPAPKNLVVSRVTEDSARLSWTAPDAAFDSFHIEYAEPWVWGEAIVLTVPGSERSYDLTGLKPGTEYVVFIGGVKGGHRSTPLSAIFTT

SEQ ID NO: 789 - protein, 89 aa, Artificial
  Synthetic Luk26T81N
LPAPKNLVVSRVTEDSARLSWTAPDAAFDSFHIEYAEPWVWGEAIVLTVPGSERSYDLTGLKPGTEYVVFIGGVKGGHNSNPLSAIFTT

SEQ ID NO: 790 - protein, 89 aa, Artificial
  Synthetic Luk26wtFG
LPAPKNLVVSRVTEDSARLSWTAPDAAFDSFHIEYAEPWVWGEAIVLTVPGSERSYDLTGLKPGTEYVVFIGGVKGGHRSNPLSAIFTT

SEQ ID NO: 791 - protein, 96 aa, Artificial
  Synthetic Luk26S38FG
LPAPKNLVVSRVTEDSARLSWTAPDAAFDSFHIEYAEPWVWGEAIVLTVPGSERSYDLTGLKPGTEYVVFIGGVELIYHGWLDFVFSNPLSAIFTT

SEQ ID NO: 792 - protein, 89 aa, Artificial
  Synthetic Luk26V68D
LPAPKNLVVSRVTEDSARLSWTAPDAAFDSFHIEYAEPWVWGEAIVLTVPGSERSYDLTGLKPGTEYDVFIGGVKGGHNSTPLSAIFTT

SEQ ID NO: 793 - protein, 89 aa, Artificial; identical to SEQ ID NO: 786
  Synthetic Luk26V68T

SEQ ID NO: 794 - protein, 89 aa, Artificial
  Synthetic Luk26V68Q
LPAPKNLVVSRVTEDSARLSWTAPDAAFDSFHIEYAEPWVWGEAIVLTVPGSERSYDLTGLKPGTEYQVFIGGVKGGHNSTPLSAIFTT

SEQ ID NO: 795 - protein, 89 aa, Artificial
  Synthetic Luk26W39Q
LPAPKNLVVSRVTEDSARLSWTAPDAAFDSFHIEYAEPQVWGEAIVLTVPGSERSYDLTGLKPGTEYVVFIGGVKGGHNSTPLSAIFTT

SEQ ID NO: 796 - protein, 89 aa, Artificial
  Synthetic Luk26W39T
LPAPKNLVVSRVTEDSARLSWTAPDAAFDSFHIEYAEPTVWGEAIVLTVPGSERSYDLTGLKPGTEYVVFIGGVKGGHNSTPLSAIFTT

SEQ ID NO: 797 - protein, 89 aa, Artificial
  Synthetic Luk26S84D
LPAPKNLVVSRVTEDSARLSWTAPDAAFDSFHIEYAEPWVWGEAIVLTVPGSERSYDLTGLKPGTEYVVFIGGVKGGHNSTPLDAIFTT

SEQ ID NO: 798 - protein, 89 aa, Artificial
  Synthetic Luk26S84T
LPAPKNLVVSRVTEDSARLSWTAPDAAFDSFHIEYAEPWVWGEAIVLTVPGSERSYDLTGLKPGTEYVVFIGGVKGGHNSTPLTAIFTT

SEQ ID NO: 799 - protein, 89 aa, Artificial
  Synthetic Luk26S84Q
LPAPKNLVVSRVTEDSARLSWTAPDAAFDSFHIEYAEPWVWGEAIVLTVPGSERSYDLTGLKPGTEYVVFIGGVKGGHNSTPLQAIFTT

SEQ ID NO: 800 - protein, 89 aa, Artificial
  Synthetic Luk26W41Q
LPAPKNLVVSRVTEDSARLSWTAPDAAFDSFHIEYAEPWVQGEAIVLTVPGSERSYDLTGLKPGTEYVVFIGGVKGGHNSTPLSAIFTT

SEQ ID NO: 801 - protein, 89 aa, Artificial
  Synthetic Luk26W41T
LPAPKNLVVSRVTEDSARLSWTAPDAAFDSFHIEYAEPWVTGEAIVLTVPGSERSYDLTGLKPGTEYVVFIGGVKGGHNSTPLSAIFTT

SEQ ID NO: 802 - protein, 89 aa, Artificial
  Synthetic Luk26V68DS84D
LPAPKNLVVSRVTEDSARLSWTAPDAAFDSFHIEYAEPWVWGEAIVLTVPGSERSYDLTGLKPGTEYDVFIGGVKGGHNSTPLDAIFTT

SEQ ID NO: 803 - protein, 89 aa, Artificial
  Synthetic Luk26V68DS84T
LPAPKNLVVSRVTEDSARLSWTAPDAAFDSFHIEYAEPWVWGEAIVLTVPGSERSYDLTGLKPGTEYDVFIGGVKGGHNSTPLTAIFTT

SEQ ID NO: 804 - protein, 89 aa, Artificial
  Synthetic Luk26V68TS84D
LPAPKNLVVSRVTEDSARLSWTAPDAAFDSFHIEYAEPWVWGEAIVLTVPGSERSYDLTGLKPGTEYTVFIGGVKGGHNSTPLDAIFTT

SEQ ID NO: 805 - protein, 89 aa, Artificial
  Synthetic Luk26V68TS84T
LPAPKNLVVSRVTEDSARLSWTAPDAAFDSFHIEYAEPWVWGEAIVLTVPGSERSYDLTGLKPGTEYTVFIGGVKGGHNSTPLTAIFTT

SEQ ID NO: 806 - protein, 89 aa, Artificial
  Synthetic Luk26V68QS84Q
LPAPKNLVVSRVTEDSARLSWTAPDAAFDSFHIEYAEPWVWGEAIVLTVPGSERSYDLTGLKPGTEYQVFIGGVKGGHNSTPLQAIFTT

SEQ ID NO: 807 - protein, 89 aa, Artificial
  Synthetic Luk26V68QS84D
LPAPKNLVVSRVTEDSARLSWTAPDAAFDSFHIEYAEPWVWGEAIVLTVPGSERSYDLTGLKPGTEYQVFIGGVKGGHNSTPLDAIFTT

SEQ ID NO: 808 - protein, 89 aa, Artificial
  Synthetic Luk26V68QS84T
LPAPKNLVVSRVTEDSARLSWTAPDAAFDSFHIEYAEPWVWGEAIVLTVPGSERSYDLTGLKPGTEYQVFIGGVKGGHNSTPLTAIFTT

SEQ ID NO: 809 - protein, 89 aa, Artificial
  Synthetic Luk26V68DS84Q
LPAPKNLVVSRVTEDSARLSWTAPDAAFDSFHIEYAEPWVWGEAIVLTVPGSERSYDLTGLKPGTEYDVFIGGVKGGHNSTPLQAIFTT

SEQ ID NO: 810 - protein, 89 aa, Artificial
  Synthetic Luk26V68TS84Q
LPAPKNLVVSRVTEDSARLSWTAPDAAFDSFHIEYAEPWVWGEAIVLTVPGSERSYDLTGLKPGTEYTVFIGGVKGGHNSTPLQAIFTT

SEQ ID NO: 811 - protein, 89 aa, Artificial
  Synthetic Luk26W39QW41Q
LPAPKNLVVSRVTEDSARLSWTAPDAAFDSFHIEYAEPQVQGEAIVLTVPGSERSYDLTGLKPGTEYVVFIGGVKGGHNSTPLSAIFTT

SEQ ID NO: 812 - protein, 89 aa, Artificial
  Synthetic Luk26W39QW41T
LPAPKNLVVSRVTEDSARLSWTAPDAAFDSFHIEYAEPQVTGEAIVLTVPGSERSYDLTGLKPGTEYVVFIGGVKGGHNSTPLSAIFTT

SEQ ID NO: 813 - protein, 89 aa, Artificial
  Synthetic Luk26W39TW41Q
LPAPKNLVVSRVTEDSARLSWTAPDAAFDSFHIEYAEPTVQGEAIVLTVPGSERSYDLTGLKPGTEYVVFIGGVKGGHNSTPLSAIFTT

SEQ ID NO: 814 - protein, 89 aa, Artificial
  Synthetic Luk26W39TW41T
LPAPKNLVVSRVTEDSARLSWTAPDAAFDSFHIEYAEPTVTGEAIVLTVPGSERSYDLTGLKPGTEYVVFIGGVKGGHNSTPLSAIFTT

SEQ ID NO: 815 - protein, 89 aa, Artificial
  Synthetic Luk27P32A
LPAPKNLVVSRVTEDSARLSWTAPDAAFDSFAIVYQEWQFYGEAIVLTVPGSERSYDLTGLKPGTEYLVDIYGVKGGSWSYPLSAIFTT

SEQ ID NO: 816 - protein, 89 aa, Artificial
  Synthetic Luk27V34A
LPAPKNLVVSRVTEDSARLSWTAPDAAFDSFPIAYQEWQFYGEAIVLTVPGSERSYDLTGLKPGTEYLVDIYGVKGGSWSYPLSAIFTT

SEQ ID NO: 817 - protein, 89 aa, Artificial
  Synthetic Luk27Q36A
LPAPKNLVVSRVTEDSARLSWTAPDAAFDSFPIVYAEWQFYGEAIVLTVPGSERSYDLTGLKPGTEYLVDIYGVKGGSWSYPLSAIFTT

SEQ ID NO: 818 - protein, 89 aa, Artificial
  Synthetic Luk27W38A
LPAPKNLVVSRVTEDSARLSWTAPDAAFDSFPIVYQEAQFYGEAIVLTVPGSERSYDLTGLKPGTEYLVDIYGVKGGSWSYPLSAIFTT

SEQ ID NO: 819 - protein, 89 aa, Artificial
  Synthetic Luk27Q39A
LPAPKNLVVSRVTEDSARLSWTAPDAAFDSFPIVYQEWAFYGEAIVLTVPGSERSYDLTGLKPGTEYLVDIYGVKGGSWSYPLSAIFTT

SEQ ID NO: 820 - protein, 89 aa, Artificial
  Synthetic Luk27F40A
LPAPKNLVVSRVTEDSARLSWTAPDAAFDSFPIVYQEWQAYGEAIVLTVPGSERSYDLTGLKPGTEYLVDIYGVKGGSWSYPLSAIFTT

SEQ ID NO: 821 - protein, 89 aa, Artificial
  Synthetic Luk27Y41A
LPAPKNLVVSRVTEDSARLSWTAPDAAFDSFPIVYQEWQFAGEAIVLTVPGSERSYDLTGLKPGTEYLVDIYGVKGGSWSYPLSAIFTT

SEQ ID NO: 822 - protein, 89 aa, Artificial
  Synthetic Luk27L68A
LPAPKNLVVSRVTEDSARLSWTAPDAAFDSFPIVYQEWQFYGEAIVLTVPGSERSYDLTGLKPGTEYAVDIYGVKGGSWSYPLSAIFTT

SEQ ID NO: 823 - protein, 89 aa, Artificial
  Synthetic Luk27D70A
LPAPKNLVVSRVTEDSARLSWTAPDAAFDSFPIVYQEWQFYGEAIVLTVPGSERSYDLTGLKPGTEYLVAIYGVKGGSWSYPLSAIFTT

SEQ ID NO: 824 - protein, 89 aa, Artificial
  Synthetic Luk27Y72A
LPAPKNLVVSRVTEDSARLSWTAPDAAFDSFPIVYQEWQFYGEAIVLTVPGSERSYDLTGLKPGTEYLVDIAGVKGGSWSYPLSAIFTT

SEQ ID NO: 825 - protein, 89 aa, Artificial
  Synthetic Luk27S78A
LPAPKNLVVSRVTEDSARLSWTAPDAAFDSFPIVYQEWQFYGEAIVLTVPGSERSYDLTGLKPGTEYLVDIYGVKGGAWSYPLSAIFTT

SEQ ID NO: 826 - protein, 89 aa, Artificial
  Synthetic Luk27W79A
LPAPKNLVVSRVTEDSARLSWTAPDAAFDSFPIVYQEWQFYGEAIVLTVPGSERSYDLTGLKPGTEYLVDIYGVKGGSASYPLSAIFTT

SEQ ID NO: 827 - protein, 89 aa, Artificial
  Synthetic Luk27Y81A
LPAPKNLVVSRVTEDSARLSWTAPDAAFDSFPIVYQEWQFYGEAIVLTVPGSERSYDLTGLKPGTEYLVDIYGVKGGSWSAPLSAIFTT

SEQ ID NO: 828 - protein, 96 aa, Artificial
  Synthetic Luk38E75A
LPAPKNLVVSRVTEDSARLSWTAPDAAFDSFLIQYQESEKVGEAIVLTVPGSERSYDLTGLKPGTEYTVSIYGVALIYHGWLDFVFSNPLSAIFTT

SEQ ID NO: 829 - protein, 96 aa, Artificial
  Synthetic Luk38L76A
LPAPKNLVVSRVTEDSARLSWTAPDAAFDSFLIQYQESEKVGEAIVLTVPGSERSYDLTGLKPGTEYTVSIYGVEAIYHGWLDFVFSNPLSAIFTT

SEQ ID NO: 830 - protein, 96 aa, Artificial
  Synthetic Luk38I77A
LPAPKNLVVSRVTEDSARLSWTAPDAAFDSFLIQYQESEKVGEAIVLTVPGSERSYDLTGLKPGTEYTVSIYGVELAYHGWLDFVFSNPLSAIFTT

SEQ ID NO: 831 - protein, 96 aa, Artificial
  Synthetic Luk38Y78A
LPAPKNLVVSRVTEDSARLSWTAPDAAFDSFLIQYQESEKVGEAIVLTVPGSERSYDLTGLKPGTEYTVSIYGVELIAHGWLDFVFSNPLSAIFTT

SEQ ID NO: 832 - protein, 96 aa, Artificial
  Synthetic Luk38H79A
LPAPKNLVVSRVTEDSARLSWTAPDAAFDSFLIQYQESEKVGEAIVLTVPGSERSYDLTGLKPGTEYTVSIYGVELIYAGWLDFVFSNPLSAIFTT

SEQ ID NO: 833 - protein, 96 aa, Artificial
  Synthetic Luk38G80A
LPAPKNLVVSRVTEDSARLSWTAPDAAFDSFLIQYQESEKVGEAIVLTVPGSERSYDLTGLKPGTEYTVSIYGVELIYHAWLDFVFSNPLSAIFTT

SEQ ID NO: 834 - protein, 96 aa, Artificial
  Synthetic Luk38W81A
LPAPKNLVVSRVTEDSARLSWTAPDAAFDSFLIQYQESEKVGEAIVLTVPGSERSYDLTGLKPGTEYTVSIYGVELIYHGALDFVFSNPLSAIFTT

SEQ ID NO: 835 - protein, 96 aa, Artificial
  Synthetic Luk38L82A
LPAPKNLVVSRVTEDSARLSWTAPDAAFDSFLIQYQESEKVGEAIVLTVPGSERSYDLTGLKPGTEYTVSIYGVELIYHGWADFVFSNPLSAIFTT

SEQ ID NO: 836 - protein, 96 aa, Artificial
  Synthetic Luk38D83A
LPAPKNLVVSRVTEDSARLSWTAPDAAFDSFLIQYQESEKVGEAIVLTVPGSERSYDLTGLKPGTEYTVSIYGVELIYHGWLAFVFSNPLSAIFTT

SEQ ID NO: 837 - protein, 96 aa, Artificial
  Synthetic Luk38F84A
LPAPKNLVVSRVTEDSARLSWTAPDAAFDSFLIQYQESEKVGEAIVLTVPGSERSYDLTGLKPGTEYTVSIYGVELIYHGWLDAVFSNPLSAIFTT

SEQ ID NO: 838 - protein, 96 aa, Artificial
  Synthetic Luk38V85A
LPAPKNLVVSRVTEDSARLSWTAPDAAFDSFLIQYQESEKVGEAIVLTVPGSERSYDLTGLKPGTEYTVSIYGVELIYHGWLDFAFSNPLSAIFTT

SEQ ID NO: 839 - protein, 96 aa, Artificial
  Synthetic Luk38F86A
LPAPKNLVVSRVTEDSARLSWTAPDAAFDSFLIQYQESEKVGEAIVLTVPGSERSYDLTGLKPGTEYTVSIYGVELIYHGWLDFVASNPLSAIFTT

SEQ ID NO: 840 - protein, 214 aa, Homo sapiens; identical to SEQ ID NO: 61

SEQ ID NO: 841 - protein, 214 aa, Homo sapiens
EIVLTQSPATLSLSPGERATLSCRASQSVADDLAWYQQKPGQAPRLLIYFASNRATGIPARFSGSGSGTDFTLTISSLEPEDFAVYYCQQRYGWPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 842 - protein, 214 aa, Homo sapiens
EIVLTQSPATLSLSPGERATLSCRASQSVSNALAWYQQKPGQAPRLLIYGAGNRATGIPARFSGSGSGTDFTLTISSLEPEDFAVYYCQQRHNWPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 843 - protein, 218 aa, Homo sapiens; identical to SEQ ID NO: 105

SEQ ID NO: 844 - protein, 215 aa, Homo sapiens
EIVMTQSPATLSVSPGERATLSCRASQYVSDNLAWYQQKPGQAPRLLIYGASTRATGVPARFSGSGSGTEFTLTISSLQSEDFAVYYCQQYNNWRPVTFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 845 - protein, 217 aa, Homo sapiens
QSALTQPPSASGSPGQSVTISCTGTSSDVGGYNYVSWYQQRPGKAPKLMIYDVSNRPSGVSDRFSGSKSGNTASLTISGLQAEDEADYYCSSYTTGSTLVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 846 - protein, 213 aa, Homo sapiens; identical to SEQ ID NO: 103

SEQ ID NO: 847 - protein, 212 aa, Homo sapiens
QSVLTQPPSLSVSPGQTASISCSGDKLGDKYVSWYQQRPGQSPVLVIYHDTKRPSGIPERFSGTNSGNTATLTISGTQILDEADYYCQVWDRSTVVFGGGTQLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 848 - protein, 559 aa, Homo sapiens
EVQLVETGGGLVKPGGSLRLSCSASRFSFRDYYMTWIRQAPGKGPEWVSHISGSGSTIYYADSVRGRFTISRDNAKSSLYLQMDSLQADDTAVYYCARGGRATSYYWVHWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPDVFLFPPKPKDTLMISRTPEVTCVVVDVSHEDPEVKFNWYVDGVEVHNAKTKPREEQYNSTYRVVSVLTVLHQDWLNGKEYKCKVSNAALPAPIAKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNRFTQKSLSLSPGKGGGGSGGGGSGGGGSGGGGSMLPAPKNLVVSRVTEDSARLSWTAPDAAFDSFHIEYAEPWVWGEAIVLTVPGSERSYDLTGLKPGTEYVVFIGGVKGGHNSTPLSAIFTT

SEQ ID NO: 849 - protein, 558 aa, Homo sapiens
EVQLVETGGGLVKPGGSLRLSCSASRFSFRDYYMTWIRQAPGKGPEWVSHISGSGSTIYYADSVRGRFTISRDNAKSSLYLQMDSLQADDTAVYYCARGGRATSYYWVHWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPDVFLFPPKPKDTLMISRTPEVTCVVVDVSHEDPEVKFNWYVDGVEVHNAKTKPREEQYNSTYRVVSVLTVLHQDWLNGKEYKCKVSNAALPAPIAKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNRFTQKSLSLSPGKGGGGSGGGGSGGGGSGGGGSLPAPKNLVVSRVTEDSARLSWTAPDAAFDSFHIEYAEPWVWGEAIVLTVPGSERSYDLTGLKPGTEYVVFIGGVKGGHNSTPLSAIFTT

SEQ ID NO: 850 - protein, 559 aa, Homo sapiens
EVQLVETGGGLVKPGGSLRLSCSASRFSFRDYYMTWIRQAPGKGPEWVSHISGSGSTIYYADSVRGRFTISRDNAKSSLYLQMDSLQADDTAVYYCARGGRATSYYWVHWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPDVFLFPPKPKDTLMISRTPEVTCVVVDVSHEDPEVKFNWYVDGVEVHNAKTKPREEQYNSTYRVVSVLTVLHQDWLNGKEYKCKVSNAALPAPIAKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNRFTQKSLSLSPGKGGGGSGGGGSGGGGSGGGGSMLPAPKNLVVSRVTEDSARLSWTAPDAAFDSFPIVYQEWQFYGEAIVLTVPGSERSYDLTGLKPGTEYLVDIYGVKGGSWSYPLSAIFTT

SEQ ID NO: 851 - protein, 558 aa, Homo sapiens
EVQLVETGGGLVKPGGSLRLSCSASRFSFRDYYMTWIRQAPGKGPEWVSHISGSGSTIYYADSVRGRFTISRDNAKSSLYLQMDSLQADDTAVYYCARGGRATSYYWVHWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPDVFLFPPKPKDTLMISRTPEVTCVVVDVSHEDPEVKFNWYVDGVEVHNAKTKPREEQYNSTYRVVSVLTVLHQDWLNGKEYKCKVSNAALPAPIAKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNRFTQKSLSLSPGKGGGGSGGGGSGGGGSGGGGSLPAPKNLVVSRVTEDSARLSWTAPDAAFDSFPIVYQEWQFYGEAIVLTVPGSERSYDLTGLKPGTEYLVDIYGVKGGSWSYPLSAIFTT

SEQ ID NO: 852 - protein, 669 aa, Homo sapiens
EVQLVETGGGLVKPGGSLRLSCSASRFSFRDYYMTWIRQAPGKGPEWVSHISGSGSTIYYADSVRGRFTISRDNAKSSLYLQMDSLQADDTAVYYCARGGRATSYYWVHWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPDVFLFPPKPKDTLMISRTPEVTCVVVDVSHEDPEVKFNWYVDGVEVHNAKTKPREEQYNSTYRVVSVLTVLHQDWLNGKEYKCKVSNAALPAPIAKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNRFTQKSLSLSPGKGGGGSGGGGSGGGGSGGGGSMLPAPKNLVVSRVTEDSARLSWTAPDAAFDSFWITYEEKFYRGEAIVLTVPGSERSYDLTGLKPGTEYKVWIVGVKGGQGSWPLSAIFTTGGGGSGGGGSGGGGSGGGGSMLPAPKNLVVSRVTEDSARLSWTAPDAAFDSFHIEYAEPWVWGEAIVLTVPGSERSYDLTGLKPGTEYVVFIGGVKGGHNSTPLSAIFTT

SEQ ID NO: 853 - protein, 668 aa, Homo sapiens
EVQLVETGGGLVKPGGSLRLSCSASRFSFRDYYMTWIRQAPGKGPEWVSHISGSGSTIYYADSVRGRFTISRDNAKSSLYLQMDSLQADDTAVYYCARGGRATSYYWVHWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPDVFLFPPKPKDTLMISRTPEVTCVVVDVSHEDPEVKFNWYVDGVEVHNAKTKPREEQYNSTYRVVSVLTVLHQDWLNGKEYKCKVSNAALPAPIAKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNRFTQKSLSLSPGKGGGGSGGGGSGGGGSGGGGSMLPAPKNLVVSRVTEDSARLSWTAPDAAFDSFWITYEEKFYRGEAIVLTVPGSERSYDLTGLKPGTEYKVWIVGVKGGQGSWPLSAIFTTGGGGSGGGGSGGGGSGGGGSLPAPKNLVVSRVTEDSARLSWTAPDAAFDSFHIEYAEPWVWGEAIVLTVPGSERSYDLTGLKPGTEYVVFIGGVKGGHNSTPLSAIFTT

SEQ ID NO: 854 - protein, 669 aa, Homo sapiens
EVQLVETGGGLVKPGGSLRLSCSASRFSFRDYYMTWIRQAPGKGPEWVSHISGSGSTIYYADSVRGRFTISRDNAKSSLYLQMDSLQADDTAVYYCARGGRATSYYWVHWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPDVFLFPPKPKDTLMISRTPEVTCVVVDVSHEDPEVKFNWYVDGVEVHNAKTKPREEQYNSTYRVVSVLTVLHQDWLNGKEYKCKVSNAALPAPIAKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNRFTQKSLSLSPGKGGGGSGGGGSGGGGSGGGGSMLPAPKNLVVSRVTEDSARLSWTAPDAAFDSFWITYEEKFYRGEAIVLTVPGSERSYDLTGLKPGTEYKVWIVGVKGGQGSWPLSAIFTTGGGGSGGGGSGGGGSGGGGSMLPAPKNLVVSRVTEDSARLSWTAPDAAFDSFPIVYQEWQFYGEAIVLTVPGSERSYDLTGLKPGTEYLVDIYGVKGGSWSYPLSAIFTT

SEQ ID NO: 855 - protein, 668 aa, Homo sapiens
EVQLVETGGGLVKPGGSLRLSCSASRFSFRDYYMTWIRQAPGKGPEWVSHISGSGSTIYYADSVRGRFTISRDNAKSSLYLQMDSLQADDTAVYYCARGGRATSYYWVHWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPDVFLFPPKPKDTLMISRTPEVTCVVVDVSHEDPEVKFNWYVDGVEVHNAKTKPREEQYNSTYRVVSVLTVLHQDWLNGKEYKCKVSNAALPAPIAKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNRFTQKSLSLSPGKGGGGSGGGGSGGGGSGGGGSMLPAPKNLVVSRVTEDSARLSWTAPDAAFDSFWITYEEKFYRGEAIVLTVPGSERSYDLTGLKPGTEYKVWIVGVKGGQGSWPLSAIFTTGGGGSGGGGSGGGGSGGGGSLPAPKNLVVSRVTEDSARLSWTAPDAAFDSFPIVYQEWQFYGEAIVLTVPGSERSYDLTGLKPGTEYLVDIYGVKGGSWSYPLSAIFTT

SEQ ID NO: 856 - protein, 669 aa, Homo sapiens
EVQLVETGGGLVKPGGSLRLSCSASRFSFRDYYMTWIRQAPGKGPEWVSHISGSGSTIYYADSVRGRFTISRDNAKSSLYLQMDSLQADDTAVYYCARGGRATSYYWVHWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPDVFLFPPKPKDTLMISRTPEVTCVVVDVSHEDPEVKFNWYVDGVEVHNAKTKPREEQYNSTYRVVSVLTVLHQDWLNGKEYKCKVSNAALPAPIAKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNRFTQKSLSLSPGKGGGGSGGGGSGGGGSGGGGSMLPAPKNLVVSRVTEDSARLSWTAPDAAFDSFHIEYAEPWVWGEAIVLTVPGSERSYDLTGLKPGTEYVVFIGGVKGGHNSTPLSAIFTTGGGGSGGGGSGGGGSGGGGSMLPAPKNLVVSRVTEDSARLSWTAPDAAFDSFWITYEEKFYRGEAIVLTVPGSERSYDLTGLKPGTEYKVWIVGVKGGQGSWPLSAIFTT

SEQ ID NO: 857 - protein, 668 aa, Homo sapiens
EVQLVETGGGLVKPGGSLRLSCSASRFSFRDYYMTWIRQAPGKGPEWVSHISGSGSTIYYADSVRGRFTISRDNAKSSLYLQMDSLQADDTAVYYCARGGRATSYYWVHWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPDVFLFPPKPKDTLMISRTPEVTCVVVDVSHEDPEVKFNWYVDGVEVHNAKTKPREEQYNSTYRVVSVLTVLHQDWLNGKEYKCKVSNAALPAPIAKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNRFTQKSLSLSPGKGGGGSGGGGSGGGGSGGGGSLPAPKNLVVSRVTEDSARLSWTAPDAAFDSFHIEYAEPWVWGEAIVLTVPGSERSYDLTGLKPGTEYVVFIGGVKGGHNSTPLSAIFTTGGGGSGGGGSGGGGSGGGGSMLPAPKNLVVSRVTEDSARLSWTAPDAAFDSFWITYEEKFYRGEAIVLTVPGSERSYDLTGLKPGTEYKVWIVGVKGGQGSWPLSAIFTT

SEQ ID NO: 858 - protein, 669 aa, Homo sapiens
EVQLVETGGGLVKPGGSLRLSCSASRFSFRDYYMTWIRQAPGKGPEWVSHISGSGSTIYYADSVRGRFTISRDNAKSSLYLQMDSLQADDTAVYYCARGGRATSYYWVHWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPDVFLFPPKPKDTLMISRTPEVTCVVVDVSHEDPEVKFNWYVDGVEVHNAKTKPREEQYNSTYRVVSVLTVLHQDWLNGKEYKCKVSNAALPAPIAKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNRFTQKSLSLSPGKGGGGSGGGGSGGGGSGGGGSMLPAPKNLVVSRVTEDSARLSWTAPDAAFDSFPIVYQEWQFYGEAIVLTVPGSERSYDLTGLKPGTEYLVDIYGVKGGSWSYPLSAIFTTGGGGSGGGGSGGGGSGGGGSMLPAPKNLVVSRVTEDSARLSWTAPDAAFDSFWITYEEKFYRGEAIVLTVPGSERSYDLTGLKPGTEYKVWIVGVKGGQGSWPLSAIFTT

SEQ ID NO: 859 - protein, 668 aa, Homo sapiens
EVQLVETGGGLVKPGGSLRLSCSASRFSFRDYYMTWIRQAPGKGPEWVSHISGSGSTIYYADSVRGRFTISRDNAKSSLYLQMDSLQADDTAVYYCARGGRATSYYWVHWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPDVFLFPPKPKDTLMISRTPEVTCVVVDVSHEDPEVKFNWYVDGVEVHNAKTKPREEQYNSTYRVVSVLTVLHQDWLNGKEYKCKVSNAALPAPIAKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNRFTQKSLSLSPGKGGGGSGGGGSGGGGSGGGGSLPAPKNLVVSRVTEDSARLSWTAPDAAFDSFPIVYQEWQFYGEAIVLTVPGSERSYDLTGLKPGTEYLVDIYGVKGGSWSYPLSAIFTTGGGGSGGGGSGGGGSGGGGSMLPAPKNLVVSRVTEDSARLSWTAPDAAFDSFWITYEEKFYRGEAIVLTVPGSERSYDLTGLKPGTEYKVWIVGVKGGQGSWPLSAIFTT

SEQ ID NO: 860 - protein, 556 aa, Homo sapiens
QVQLVQSGAEVKKPGSSVKVSCKASGGTFSSYAISWVRQAPGQGLEWMGWISAINGNTNYAQKFQGRVTITADESTSTAYMELSSLRSEDTAVYYCARIWNFLLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPDVFLFPPKPKDTLMISRTPEVTCVVVDVSHEDPEVKFNWYVDGVEVHNAKTKPREEQYNSTYRVVSVLTVLHQDWLNGKEYKCKVSNAALPAPIAKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNRFTQKSLSLSPGKGGGGSGGGGSGGGGSGGGGSMLPAPKNLVVSRVTEDSARLSWTAPDAAFDSFHIEYAEPWVWGEAIVLTVPGSERSYDLTGLKPGTEYVVFIGGVKGGHNSTPLSAIFTT

SEQ ID NO: 861 - protein, 555 aa, Homo sapiens
QVQLVQSGAEVKKPGSSVKVSCKASGGTFSSYAISWVRQAPGQGLEWMGWISAINGNTNYAQKFQGRVTITADESTSTAYMELSSLRSEDTAVYYCARIWNFLLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPDVFLFPPKPKDTLMISRTPEVTCVVVDVSHEDPEVKFNWYVDGVEVHNAKTKPREEQYNSTYRVVSVLTVLHQDWLNGKEYKCKVSNAALPAPIAKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNRFTQKSLSLSPGKGGGGSGGGGSGGGGSGGGGSLPAPKNLVVSRVTEDSARLSWTAPDAAFDSFHIEYAEPWVWGEAIVLTVPGSERSYDLTGLKPGTEYVVFIGGVKGGHNSTPLSAIFTT

SEQ ID NO: 862 - protein, 556 aa, Homo sapiens
QVQLVQSGAEVKKPGSSVKVSCKASGGTFSSYAISWVRQAPGQGLEWMGWISAINGNTNYAQKFQGRVTITADESTSTAYMELSSLRSEDTAVYYCARIWNFLLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPDVFLFPPKPKDTLMISRTPEVTCVVVDVSHEDPEVKFNWYVDGVEVHNAKTKPREEQYNSTYRVVSVLTVLHQDWLNGKEYKCKVSNAALPAPIAKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNRFTQKSLSLSPGKGGGGSGGGGSGGGGSGGGGSMLPAPKNLVVSRVTEDSARLSWTAPDAAFDSFPIVYQEWQFYGEAIVLTVPGSERSYDLTGLKPGTEYLVDIYGVKGGSWSYPLSAIFTT

SEQ ID NO: 863 - protein, 555 aa, Homo sapiens
QVQLVQSGAEVKKPGSSVKVSCKASGGTFSSYAISWVRQAPGQGLEWMGWISAINGNTNYAQKFQGRVTITADESTSTAYMELSSLRSEDTAVYYCARIWNFLLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPDVFLFPPKPKDTLMISRTPEVTCVVVDVSHEDPEVKFNWYVDGVEVHNAKTKPREEQYNSTYRVVSVLTVLHQDWLNGKEYKCKVSNAALPAPIAKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNRFTQKSLSLSPGKGGGGSGGGGSGGGGSGGGGSLPAPKNLVVSRVTEDSARLSWTAPDAAFDSFPIVYQEWQFYGEAIVLTVPGSERSYDLTGLKPGTEYLVDIYGVKGGSWSYPLSAIFTT

SEQ ID NO: 864 - protein, 666 aa, Homo sapiens
QVQLVQSGAEVKKPGSSVKVSCKASGGTFSSYAISWVRQAPGQGLEWMGWISAINGNTNYAQKFQGRVTITADESTSTAYMELSSLRSEDTAVYYCARIWNFLLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPDVFLFPPKPKDTLMISRTPEVTCVVVDVSHEDPEVKFNWYVDGVEVHNAKTKPREEQYNSTYRVVSVLTVLHQDWLNGKEYKCKVSNAALPAPIAKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNRFTQKSLSLSPGKGGGGSGGGGSGGGGSGGGGSMLPAPKNLVVSRVTEDSARLSWTAPDAAFDSFWITYEEKFYRGEAIVLTVPGSERSYDLTGLKPGTEYKVWIVGVKGGQGSWPLSAIFTTGGGGSGGGGSGGGGSGGGGSMLPAPKNLVVSRVTEDSARLSWTAPDAAFDSFHIEYAEPWVWGEAIVLTVPGSERSYDLTGLKPGTEYVVFIGGVKGGHNSTPLSAIFTT

SEQ ID NO: 865 - protein, 665 aa, Homo sapiens
QVQLVQSGAEVKKPGSSVKVSCKASGGTFSSYAISWVRQAPGQGLEWMGWISAINGNTNYAQKFQGRVTITADESTSTAYMELSSLRSEDTAVYYCARIWNFLLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPDVFLFPPKPKDTLMISRTPEVTCVVVDVSHEDPEVKFNWYVDGVEVHNAKTKPREEQYNSTYRVVSVLTVLHQDWLNGKEYKCKVSNAALPAPIAKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNRFTQKSLSLSPGKGGGGSGGGGSGGGGSGGGGSMLPAPKNLVVSRVTEDSARLSWTAPDAAFDSFWITYEEKFYRGEAIVLTVPGSERSYDLTGLKPGTEYKVWIVGVKGGQGSWPLSAIFTTGGGGSGGGGSGGGGSGGGGSLPAPKNLVVSRVTEDSARLSWTAPDAAFDSFHIEYAEPWVWGEAIVLTVPGSERSYDLTGLKPGTEYVVFIGGVKGGHNSTPLSAIFTT

SEQ ID NO: 866 - protein, 666 aa, Homo sapiens
QVQLVQSGAEVKKPGSSVKVSCKASGGTFSSYAISWVRQAPGQGLEWMGWISAINGNTNYAQKFQGRVTITADESTSTAYMELSSLRSEDTAVYYCARIWNFLLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPDVFLFPPKPKDTLMISRTPEVTCVVVDVSHEDPEVKFNWYVDGVEVHNAKTKPREEQYNSTYRVVSVLTVLHQDWLNGKEYKCKVSNAALPAPIAKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNRFTQKSLSLSPGKGGGGSGGGGSGGGGSGGGGSMLPAPKNLVVSRVTEDSARLSWTAPDAAFDSFWITYEEKFYRGEAIVLTVPGSERSYDLTGLKPGTEYKVWIVGVKGGQGSWPLSAIFTTGGGGSGGGGSGGGGSGGGGSMLPAPKNLVVSRVTEDSARLSWTAPDAAFDSFPIVYQEWQFYGEAIVLTVPGSERSYDLTGLKPGTEYLVDIYGVKGGSWSYPLSAIFTT

SEQ ID NO: 867 - protein, 665 aa, Homo sapiens
QVQLVQSGAEVKKPGSSVKVSCKASGGTFSSYAISWVRQAPGQGLEWMGWISAINGNTNYAQKFQGRVTITADESTSTAYMELSSLRSEDTAVYYCARIWNFLLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPDVFLFPPKPKDTLMISRTPEVTCVVVDVSHEDPEVKFNWYVDGVEVHNAKTKPREEQYNSTYRVVSVLTVLHQDWLNGKEYKCKVSNAALPAPIAKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNRFTQKSLSLSPGKGGGGSGGGGSGGGGSGGGGSMLPAPKNLVVSRVTEDSARLSWTAPDAAFDSFWITYEEKFYRGEAIVLTVPGSERSYDLTGLKPGTEYKVWIVGVKGGQGSWPLSAIFTTGGGGSGGGGSGGGGSGGGGSLPAPKNLVVSRVTEDSARLSWTAPDAAFDSFPIVYQEWQFYGEAIVLTVPGSERSYDLTGLKPGTEYLVDIYGVKGGSWSYPLSAIFTT

SEQ ID NO: 868 - protein, 666 aa, Homo sapiens
QVQLVQSGAEVKKPGSSVKVSCKASGGTFSSYAISWVRQAPGQGLEWMGWISAINGNTNYAQKFQGRVTITADESTSTAYMELSSLRSEDTAVYYCARIWNFLLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPDVFLFPPKPKDTLMISRTPEVTCVVVDVSHEDPEVKFNWYVDGVEVHNAKTKPREEQYNSTYRVVSVLTVLHQDWLNGKEYKCKVSNAALPAPIAKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNRFTQKSLSLSPGKGGGGSGGGGSGGGGSGGGGSMLPAPKNLVVSRVTEDSARLSWTAPDAAFDSFHIEYAEPWVWGEAIVLTVPGSERSYDLTGLKPGTEYVVFIGGVKGGHNSTPLSAIFTTGGGGSGGGGSGGGGSGGGGSMLPAPKNLVVSRVTEDSARLSWTAPDAAFDSFWITYEEKFYRGEAIVLTVPGSERSYDLTGLKPGTEYKVWIVGVKGGQGSWPLSAIFTT

SEQ ID NO: 869 - protein, 665 aa, Homo sapiens
QVQLVQSGAEVKKPGSSVKVSCKASGGTFSSYAISWVRQAPGQGLEWMGWISAINGNTNYAQKFQGRVTITADESTSTAYMELSSLRSEDTAVYYCARIWNFLLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPDVFLFPPKPKDTLMISRTPEVTCVVVDVSHEDPEVKFNWYVDGVEVHNAKTKPREEQYNSTYRVVSVLTVLHQDWLNGKEYKCKVSNAALPAPIAKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNRFTQKSLSLSPGKGGGGSGGGGSGGGGSGGGGSLPAPKNLVVSRVTEDSARLSWTAPDAAFDSFHIEYAEPWVWGEAIVLTVPGSERSYDLTGLKPGTEYVVFIGGVKGGHNSTPLSAIFTTGGGGSGGGGSGGGGSGGGGSMLPAPKNLVVSRVTEDSARLSWTAPDAAFDSFWITYEEKFYRGEAIVLTVPGSERSYDLTGLKPGTEYKVWIVGVKGGQGSWPLSAIFTT

SEQ ID NO: 870 - protein, 666 aa, Homo sapiens
QVQLVQSGAEVKKPGSSVKVSCKASGGTFSSYAISWVRQAPGQGLEWMGWISAINGNTNYAQKFQGRVTITADESTSTAYMELSSLRSEDTAVYYCARIWNFLLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPDVFLFPPKPKDTLMISRTPEVTCVVVDVSHEDPEVKFNWYVDGVEVHNAKTKPREEQYNSTYRVVSVLTVLHQDWLNGKEYKCKVSNAALPAPIAKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNRFTQKSLSLSPGKGGGGSGGGGSGGGGSGGGGSMLPAPKNLVVSRVTEDSARLSWTAPDAAFDSFPIVYQEWQFYGEAIVLTVPGSERSYDLTGLKPGTEYLVDIYGVKGGSWSYPLSAIFTTGGGGSGGGGSGGGGSGGGGSMLPAPKNLVVSRVTEDSARLSWTAPDAAFDSFWITYEEKFYRGEAIVLTVPGSERSYDLTGLKPGTEYKVWIVGVKGGQGSWPLSAIFTT

SEQ ID NO: 871 - protein, 665 aa, Homo sapiens
QVQLVQSGAEVKKPGSSVKVSCKASGGTFSSYAISWVRQAPGQGLEWMGWISAINGNTNYAQKFQGRVTITADESTSTAYMELSSLRSEDTAVYYCARIWNFLLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPDVFLFPPKPKDTLMISRTPEVTCVVVDVSHEDPEVKFNWYVDGVEVHNAKTKPREEQYNSTYRVVSVLTVLHQDWLNGKEYKCKVSNAALPAPIAKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNRFTQKSLSLSPGKGGGGSGGGGSGGGGSGGGGSLPAPKNLVVSRVTEDSARLSWTAPDAAFDSFPIVYQEWQFYGEAIVLTVPGSERSYDLTGLKPGTEYLVDIYGVKGGSWSYPLSAIFTTGGGGSGGGGSGGGGSGGGGSMLPAPKNLVVSRVTEDSARLSWTAPDAAFDSFWITYEEKFYRGEAIVLTVPGSERSYDLTGLKPGTEYKVWIVGVKGGQGSWPLSAIFTT

SEQ ID NO: 872 - protein, 560 aa, Homo sapiens
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARWSYSQYSGWLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPDVFLFPPKPKDTLMISRTPEVTCVVVDVSHEDPEVKFNWYVDGVEVHNAKTKPREEQYNSTYRVVSVLTVLHQDWLNGKEYKCKVSNAALPAPIAKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNRFTQKSLSLSPGKGGGGSGGGGSGGGGSGGGGSMLPAPKNLVVSRVTEDSARLSWTAPDAAFDSFHIEYAEPWVWGEAIVLTVPGSERSYDLTGLKPGTEYVVFIGGVKGGHNSTPLSAIFTT

SEQ ID NO: 873 - protein, 559 aa, Homo sapiens
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARWSYSQYSGWLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPDVFLFPPKPKDTLMISRTPEVTCVVVDVSHEDPEVKFNWYVDGVEVHNAKTKPREEQYNSTYRVVSVLTVLHQDWLNGKEYKCKVSNAALPAPIAKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNRFTQKSLSLSPGKGGGGSGGGGSGGGGSGGGGSLPAPKNLVVSRVTEDSARLSWTAPDAAFDSFHIEYAEPWVWGEAIVLTVPGSERSYDLTGLKPGTEYVVFIGGVKGGHNSTPLSAIFTT

SEQ ID NO: 874 - protein, 560 aa, Homo sapiens
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARWSYSQYSGWLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPDVFLFPPKPKDTLMISRTPEVTCVVVDVSHEDPEVKFNWYVDGVEVHNAKTKPREEQYNSTYRVVSVLTVLHQDWLNGKEYKCKVSNAALPAPIAKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNRFTQKSLSLSPGKGGGGSGGGGSGGGGSGGGGSMLPAPKNLVVSRVTEDSARLSWTAPDAAFDSFPIVYQEWQFYGEAIVLTVPGSERSYDLTGLKPGTEYLVDIYGVKGGSWSYPLSAIFTT

SEQ ID NO: 875 - protein, 559 aa, Homo sapiens
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARWSYSQYSGWLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPDVFLFPPKPKDTLMISRTPEVTCVVVDVSHEDPEVKFNWYVDGVEVHNAKTKPREEQYNSTYRVVSVLTVLHQDWLNGKEYKCKVSNAALPAPIAKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNRFTQKSLSLSPGKGGGGSGGGGSGGGGSGGGGSLPAPKNLVVSRVTEDSARLSWTAPDAAFDSFPIVYQEWQFYGEAIVLTVPGSERSYDLTGLKPGTEYLVDIYGVKGGSWSYPLSAIFTT

SEQ ID NO: 876 - protein, 670 aa, Homo sapiens
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARWSYSQYSGWLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPDVFLFPPKPKDTLMISRTPEVTCVVVDVSHEDPEVKFNWYVDGVEVHNAKTKPREEQYNSTYRVVSVLTVLHQDWLNGKEYKCKVSNAALPAPIAKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNRFTQKSLSLSPGKGGGGSGGGGSGGGGSGGGGSMLPAPKNLVVSRVTEDSARLSWTAPDAAFDSFWITYEEKFYRGEAIVLTVPGSERSYDLTGLKPGTEYKVWIVGVKGGQGSWPLSAIFTTGGGGSGGGGSGGGGSGGGGSMLPAPKNLVVSRVTEDSARLSWTAPDAAFDSFHIEYAEPWVWGEAIVLTVPGSERSYDLTGLKPGTEYVVFIGGVKGGHNSTPLSAIFTT

SEQ ID NO: 877 - protein, 669 aa, Homo sapiens
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARWSYSQYSGWLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPDVFLFPPKPKDTLMISRTPEVTCVVVDVSHEDPEVKFNWYVDGVEVHNAKTKPREEQYNSTYRVVSVLTVLHQDWLNGKEYKCKVSNAALPAPIAKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNRFTQKSLSLSPGKGGGGSGGGGSGGGGSGGGGSMLPAPKNLVVSRVTEDSARLSWTAPDAAFDSFWITYEEKFYRGEAIVLTVPGSERSYDLTGLKPGTEYKVWIVGVKGGQGSWPLSAIFTTGGGGSGGGGSGGGGSGGGGSLPAPKNLVVSRVTEDSARLSWTAPDAAFDSFHIEYAEPWVWGEAIVLTVPGSERSYDLTGLKPGTEYVVFIGGVKGGHNSTPLSAIFTT

SEQ ID NO: 878 - protein, 670 aa, Homo sapiens
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARWSYSQYSGWLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPDVFLFPPKPKDTLMISRTPEVTCVVVDVSHEDPEVKFNWYVDGVEVHNAKTKPREEQYNSTYRVVSVLTVLHQDWLNGKEYKCKVSNAALPAPIAKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNRFTQKSLSLSPGKGGGGSGGGGSGGGGSGGGGSMLPAPKNLVVSRVTEDSARLSWTAPDAAFDSFWITYEEKFYRGEAIVLTVPGSERSYDLTGLKPGTEYKVWIVGVKGGQGSWPLSAIFTTGGGGSGGGGSGGGGSGGGGSMLPAPKNLVVSRVTEDSARLSWTAPDAAFDSFPIVYQEWQFYGEAIVLTVPGSERSYDLTGLKPGTEYLVDIYGVKGGSWSYPLSAIFTT

SEQ ID NO: 879 - protein, 669 aa, Homo sapiens
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARWSYSQYSGWLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPDVFLFPPKPKDTLMISRTPEVTCVVVDVSHEDPEVKFNWYVDGVEVHNAKTKPREEQYNSTYRVVSVLTVLHQDWLNGKEYKCKVSNAALPAPIAKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNRFTQKSLSLSPGKGGGGSGGGGSGGGGSGGGGSMLPAPKNLVVSRVTEDSARLSWTAPDAAFDSFWITYEEKFYRGEAIVLTVPGSERSYDLTGLKPGTEYKVWIVGVKGGQGSWPLSAIFTTGGGGSGGGGSGGGGSGGGGSLPAPKNLVVSRVTEDSARLSWTAPDAAFDSFPIVYQEWQFYGEAIVLTVPGSERSYDLTGLKPGTEYLVDIYGVKGGSWSYPLSAIFTT

SEQ ID NO: 880 - protein, 670 aa, Homo sapiens
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARWSYSQYSGWLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPDVFLFPPKPKDTLMISRTPEVTCVVVDVSHEDPEVKFNWYVDGVEVHNAKTKPREEQYNSTYRVVSVLTVLHQDWLNGKEYKCKVSNAALPAPIAKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNRFTQKSLSLSPGKGGGGSGGGGSGGGGSGGGGSMLPAPKNLVVSRVTEDSARLSWTAPDAAFDSFHIEYAEPWVWGEAIVLTVPGSERSYDLTGLKPGTEYVVFIGGVKGGHNSTPLSAIFTTGGGGSGGGGSGGGGSGGGGSMLPAPKNLVVSRVTEDSARLSWTAPDAAFDSFWITYEEKFYRGEAIVLTVPGSERSYDLTGLKPGTEYKVWIVGVKGGQGSWPLSAIFTT

SEQ ID NO: 881 - protein, 669 aa, Homo sapiens
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARWSYSQYSGWLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPDVFLFPPKPKDTLMISRTPEVTCVVVDVSHEDPEVKFNWYVDGVEVHNAKTKPREEQYNSTYRVVSVLTVLHQDWLNGKEYKCKVSNAALPAPIAKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNRFTQKSLSLSPGKGGGGSGGGGSGGGGSGGGGSLPAPKNLVVSRVTEDSARLSWTAPDAAFDSFHIEYAEPWVWGEAIVLTVPGSERSYDLTGLKPGTEYVVFIGGVKGGHNSTPLSAIFTTGGGGSGGGGSGGGGSGGGGSMLPAPKNLVVSRVTEDSARLSWTAPDAAFDSFWITYEEKFYRGEAIVLTVPGSERSYDLTGLKPGTEYKVWIVGVKGGQGSWPLSAIFTT

SEQ ID NO: 882 - protein, 670 aa, Homo sapiens
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARWSYSQYSGWLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPDVFLFPPKPKDTLMISRTPEVTCVVVDVSHEDPEVKFNWYVDGVEVHNAKTKPREEQYNSTYRVVSVLTVLHQDWLNGKEYKCKVSNAALPAPIAKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNRFTQKSLSLSPGKGGGGSGGGGSGGGGSGGGGSMLPAPKNLVVSRVTEDSARLSWTAPDAAFDSFPIVYQEWQFYGEAIVLTVPGSERSYDLTGLKPGTEYLVDIYGVKGGSWSYPLSAIFTTGGGGSGGGGSGGGGSGGGGSMLPAPKNLVVSRVTEDSARLSWTAPDAAFDSFWITYEEKFYRGEAIVLTVPGSERSYDLTGLKPGTEYKVWIVGVKGGQGSWPLSAIFTT

SEQ ID NO: 883 - protein, 669 aa, Homo sapiens
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARWSYSQYSGWLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPDVFLFPPKPKDTLMISRTPEVTCVVVDVSHEDPEVKFNWYVDGVEVHNAKTKPREEQYNSTYRVVSVLTVLHQDWLNGKEYKCKVSNAALPAPIAKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNRFTQKSLSLSPGKGGGGSGGGGSGGGGSGGGGSLPAPKNLVVSRVTEDSARLSWTAPDAAFDSFPIVYQEWQFYGEAIVLTVPGSERSYDLTGLKPGTEYLVDIYGVKGGSWSYPLSAIFTTGGGGSGGGGSGGGGSGGGGSMLPAPKNLVVSRVTEDSARLSWTAPDAAFDSFWITYEEKFYRGEAIVLTVPGSERSYDLTGLKPGTEYKVWIVGVKGGQGSWPLSAIFTT

SEQ ID NO: 884 - protein, 559 aa, Homo sapiens
QITLKESGPTLVKPTQTLTLTCTFSGFSLSTSGMGVSWIRQPPGKALEWLAHIYWDDDKRYNPSLKSRLTITKDTSKNQVVLTMTNMDPVDTATYYCARLYGFTYGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSLPAPKNLVVSRVTEDSARLSWTAPDAAFDSFLIQYQESEKVGEAIVLTVPGSERSYDLTGLKPGTEYTVSIYGVKGGHRSNPLSAIFTT

SEQ ID NO: 885 - protein, 559 aa, Homo sapiens
QITLKESGPTLVKPTQTLTLTCTFSGFSLSTSGMGVSWIRQPPGKALEWLAHIYWDDDKRYNPSLKSRLTITKDTSKNQVVLTMTNMDPVDTATYYCARLYGFTYGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNRFTQKSLSLSPGKGGGGSGGGGSGGGGSGGGGSLPAPKNLVVSRVTEDSARLSWTAPDAAFDSFLIQYQESEKVGEAIVLTVPGSERSYDLTGLKPGTEYTVSIYGVKGGHRSNPLSAIFTT

SEQ ID NO: 886 - protein, 558 aa, Homo sapiens
QITLKESGPTLVKPTQTLTLTCTFSGFSLSTSGMGVSWIRQPPGKALEWLAHIYWDDDKRYNPSLKSRLTITKDTSKNQVVLTMTNMDPVDTATYYCARLYGFTYGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPDVFLFPPKPKDTLMISRTPEVTCVVVDVSHEDPEVKFNWYVDGVEVHNAKTKPREEQYNSTYRVVSVLTVLHQDWLNGKEYKCKVSNAALPAPIAKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSLPAPKNLVVSRVTEDSARLSWTAPDAAFDSFLIQYQESEKVGEAIVLTVPGSERSYDLTGLKPGTEYTVSIYGVKGGHRSNPLSAIFTT

SEQ ID NO: 887 - protein, 669 aa, Homo sapiens
EVQLVETGGGLVKPGGSLRLSCSASRFSFRDYYMTWIRQAPGKGPEWVSHISGSGSTIYYADSVRGRFTISRDNAKSSLYLQMDSLQADDTAVYYCARGGRATSYYWVHWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPDVFLFPPKPKDTLMISRTPEVTCVVVDVSHEDPEVKFNWYVDGVEVHNAKTKPREEQYNSTYRVVSVLTVLHQDWLNGKEYKCKVSNAALPAPIAKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSMLPAPKNLVVSRVTEDSARLSWTAPDAAFDSFHIEYAEPWVWGEAIVLTVPGSERSYDLTGLKPGTEYVVFIGGVKGGHNSTPLSAIFTTGGGGSGGGGSGGGGSGGGGSMLPAPKNLVVSRVTEDSARLSWTAPDAAFDSFWITYEEKFYRGEAIVLTVPGSERSYDLTGLKPGTEYKVWIVGVKGGQGSWPLSAIFTT

SEQ ID NO: 888 - protein, 668 aa, Homo sapiens
EVQLVETGGGLVKPGGSLRLSCSASRFSFRDYYMTWIRQAPGKGPEWVSHISGSGSTIYYADSVRGRFTISRDNAKSSLYLQMDSLQADDTAVYYCARGGRATSYYWVHWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPDVFLFPPKPKDTLMISRTPEVTCVVVDVSHEDPEVKFNWYVDGVEVHNAKTKPREEQYNSTYRVVSVLTVLHQDWLNGKEYKCKVSNAALPAPIAKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSLPAPKNLVVSRVTEDSARLSWTAPDAAFDSFHIEYAEPWVWGEAIVLTVPGSERSYDLTGLKPGTEYVVFIGGVKGGHNSTPLSAIFTTGGGGSGGGGSGGGGSGGGGSMLPAPKNLVVSRVTEDSARLSWTAPDAAFDSFWITYEEKFYRGEAIVLTVPGSERSYDLTGLKPGTEYKVWIVGVKGGQGSWPLSAIFTT

SEQ ID NO: 889 - protein, 666 aa, Homo sapiens
QVQLVQSGAEVKKPGSSVKVSCKASGGTFSSYAISWVRQAPGQGLEWMGWISAINGNTNYAQKFQGRVTITADESTSTAYMELSSLRSEDTAVYYCARIWNFLLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPDVFLFPPKPKDTLMISRTPEVTCVVVDVSHEDPEVKFNWYVDGVEVHNAKTKPREEQYNSTYRVVSVLTVLHQDWLNGKEYKCKVSNAALPAPIAKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSMLPAPKNLVVSRVTEDSARLSWTAPDAAFDSFHIEYAEPWVWGEAIVLTVPGSERSYDLTGLKPGTEYVVFIGGVKGGHNSTPLSAIFTTGGGGSGGGGSGGGGSGGGGSMLPAPKNLVVSRVTEDSARLSWTAPDAAFDSFWITYEEKFYRGEAIVLTVPGSERSYDLTGLKPGTEYKVWIVGVKGGQGSWPLSAIFTT

SEQ ID NO: 890 - protein, 665 aa, Homo sapiens
QVQLVQSGAEVKKPGSSVKVSCKASGGTFSSYAISWVRQAPGQGLEWMGWISAINGNTNYAQKFQGRVTITADESTSTAYMELSSLRSEDTAVYYCARIWNFLLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPDVFLFPPKPKDTLMISRTPEVTCVVVDVSHEDPEVKFNWYVDGVEVHNAKTKPREEQYNSTYRVVSVLTVLHQDWLNGKEYKCKVSNAALPAPIAKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSLPAPKNLVVSRVTEDSARLSWTAPDAAFDSFHIEYAEPWVWGEAIVLTVPGSERSYDLTGLKPGTEYVVFIGGVKGGHNSTPLSAIFTTGGGGSGGGGSGGGGSGGGGSMLPAPKNLVVSRVTEDSARLSWTAPDAAFDSFWITYEEKFYRGEAIVLTVPGSERSYDLTGLKPGTEYKVWIVGVKGGQGSWPLSAIFTT

SEQ ID NO: 891 - protein, 670 aa, Homo sapiens
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARWSYSQYSGWLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPDVFLFPPKPKDTLMISRTPEVTCVVVDVSHEDPEVKFNWYVDGVEVHNAKTKPREEQYNSTYRVVSVLTVLHQDWLNGKEYKCKVSNAALPAPIAKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSMLPAPKNLVVSRVTEDSARLSWTAPDAAFDSFHIEYAEPWVWGEAIVLTVPGSERSYDLTGLKPGTEYVVFIGGVKGGHNSTPLSAIFTTGGGGSGGGGSGGGGSGGGGSMLPAPKNLVVSRVTEDSARLSWTAPDAAFDSFWITYEEKFYRGEAIVLTVPGSERSYDLTGLKPGTEYKVWIVGVKGGQGSWPLSAIFTT

SEQ ID NO: 892 - protein, 669 aa, Homo sapiens
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARWSYSQYSGWLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPDVFLFPPKPKDTLMISRTPEVTCVVVDVSHEDPEVKFNWYVDGVEVHNAKTKPREEQYNSTYRVVSVLTVLHQDWLNGKEYKCKVSNAALPAPIAKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSLPAPKNLVVSRVTEDSARLSWTAPDAAFDSFHIEYAEPWVWGEAIVLTVPGSERSYDLTGLKPGTEYVVFIGGVKGGHNSTPLSAIFTTGGGGSGGGGSGGGGSGGGGSMLPAPKNLVVSRVTEDSARLSWTAPDAAFDSFWITYEEKFYRGEAIVLTVPGSERSYDLTGLKPGTEYKVWIVGVKGGQGSWPLSAIFTT

SEQ ID NO: 893 - protein, 668 aa, Homo sapiens
EVQLVETGGGLVKPGGSLRLSCSASRFSFRDYYMTWIRQAPGKGPEWVSHISGSGSTIYYADSVRGRFTISRDNAKSSLYLQMDSLQADDTAVYYCARGGRATSYYWVHWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPDVFLFPPKPKDTLMISRTPEVTCVVVDVSHEDPEVKFNWYVDGVEVHNAKTKPREEQYNSTYRVVSVLTVLHQDWLNGKEYKCKVSNAALPAPIAKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNRFTQKSLSLSPGGGGGSGGGGSGGGGSGGGGSMLPAPKNLVVSRVTEDSARLSWTAPDAAFDSFHIEYAEPWVWGEAIVLTVPGSERSYDLTGLKPGTEYVVFIGGVKGGHNSTPLSAIFTTGGGGSGGGGSGGGGSGGGGSMLPAPKNLVVSRVTEDSARLSWTAPDAAFDSFWITYEEKFYRGEAIVLTVPGSERSYDLTGLKPGTEYKVWIVGVKGGQGSWPLSAIFTT

SEQ ID NO: 894 - protein, 668 aa, Homo sapiens
EVQLVETGGGLVKPGGSLRLSCSASRFSFRDYYMTWIRQAPGKGPEWVSHISGSGSTIYYADSVRGRFTISRDNAKSSLYLQMDSLQADDTAVYYCARGGRATSYYWVHWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPDVFLFPPKPKDTLMISRTPEVTCVVVDVSHEDPEVKFNWYVDGVEVHNAKTKPREEQYNSTYRVVSVLTVLHQDWLNGKEYKCKVSNAALPAPIAKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSMLPAPKNLVVSRVTEDSARLSWTAPDAAFDSFHIEYAEPWVWGEAIVLTVPGSERSYDLTGLKPGTEYVVFIGGVKGGHNSTPLSAIFTTGGGGSGGGGSGGGGSGGGGSMLPAPKNLVVSRVTEDSARLSWTAPDAAFDSFWITYEEKFYRGEAIVLTVPGSERSYDLTGLKPGTEYKVWIVGVKGGQGSWPLSAIFTT

SEQ ID NO: 895 - protein, 559 aa, Homo sapiens
QITLKESGPTLVKPTQTLTLTCTFSGFSLSTSGMGVSWIRQPPGKALEWLAHIYWDDDKRYNPSLKSRLTITKDTSKNQVVLTMTNMDPVDTATYYCARLYGFTYGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPDVFLFPPKPKDTLMISRTPEVTCVVVDVSHEDPEVKFNWYVDGVEVHNAKTKPREEQYNSTYRVVSVLTVLHQDWLNGKEYKCKVSNAALPAPIAKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNRFTQKSLSLSPGKGGGGSGGGGSGGGGSGGGGSMLPAPKNLVVSRVTEDSARLSWTAPDAAFDSFLIQYQESEKVGEAIVLTVPGSERSYDLTGLKPGTEYTVSIYGVKGGHRSNPLSAIFTT

SEQ ID NO: 896 - protein, 667 aa, Homo sapiens
QITLKESGPTLVKPTQTLTLTCTFSGFSLSTSGMGVSWIRQPPGKALEWLAHIYWDDDKRYNPSLKSRLTITKDTSKNQVVLTMTNMDPVDTATYYCARLYGFTYGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPDVFLFPPKPKDTLMISRTPEVTCVVVDVSHEDPEVKFNWYVDGVEVHNAKTKPREEQYNSTYRVVSVLTVLHQDWLNGKEYKCKVSNAALPAPIAKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNRFTQKSLSLSPGKGGGGSGGGGSGGGGSGGGGSLPAPKNLVVSRVTEDSARLSWTAPDAAFDSFLIQYQESEKVGEAIVLTVPGSERSYDLTGLKPGTEYTVSIYGVKGGHRSNPLSAIFTTGGGGSGGGGSGGGGSGGGGSLPAPKNLVVSRVTEDSARLSWTAPDAAFDSFLIQYQESEKVGEAIVLTVPGSERSYDLTGLKPGTEYTVSIYGVKGGHRSNPLSAIFTT

SEQ ID NO: 897 - protein, 669 aa, Homo sapiens
QITLKESGPTLVKPTQTLTLTCTFSGFSLSTSGMGVSWIRQPPGKALEWLAHIYWDDDKRYNPSLKSRLTITKDTSKNQVVLTMTNMDPVDTATYYCARLYGFTYGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPDVFLFPPKPKDTLMISRTPEVTCVVVDVSHEDPEVKFNWYVDGVEVHNAKTKPREEQYNSTYRVVSVLTVLHQDWLNGKEYKCKVSNAALPAPIAKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNRFTQKSLSLSPGKGGGGSGGGGSGGGGSGGGGSMLPAPKNLVVSRVTEDSARLSWTAPDAAFDSFLIQYQESEKVGEAIVLTVPGSERSYDLTGLKPGTEYTVSIYGVKGGHRSNPLSAIFTTGGGGSGGGGSGGGGSGGGGSMLPAPKNLVVSRVTEDSARLSWTAPDAAFDSFLIQYQESEKVGEAIVLTVPGSERSYDLTGLKPGTEYTVSIYGVKGGHRSNPLSAIFTT

SEQ ID NO: 898 - protein, 556 aa, Homo sapiens
QVQLVQSGAEVKKPGSSVKVSCKASGGTFSSYAISWVRQAPGQGLEWMGWISAINGNTNYAQKFQGRVTITADESTSTAYMELSSLRSEDTAVYYCARIWNFLLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPDVFLFPPKPKDTLMISRTPEVTCVVVDVSHEDPEVKFNWYVDGVEVHNAKTKPREEQYNSTYRVVSVLTVLHQDWLNGKEYKCKVSNAALPAPIAKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNRFTQKSLSLSPGKGGGGSGGGGSGGGGSGGGGSMLPAPKNLVVSRVTEDSARLSWTAPDAAFDSFWITYEEKFYRGEAIVLTVPGSERSYDLTGLKPGTEYKVWIVGVKGGQGSWPLSAIFTT

SEQ ID NO: 899 - protein, 560 aa, Homo sapiens
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARWSYSQYSGWLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPDVFLFPPKPKDTLMISRTPEVTCVVVDVSHEDPEVKFNWYVDGVEVHNAKTKPREEQYNSTYRVVSVLTVLHQDWLNGKEYKCKVSNAALPAPIAKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNRFTQKSLSLSPGKGGGGSGGGGSGGGGSGGGGSMLPAPKNLVVSRVTEDSARLSWTAPDAAFDSFWITYEEKFYRGEAIVLTVPGSERSYDLTGLKPGTEYKVWIVGVKGGQGSWPLSAIFTT

SEQ ID NO: 900 - protein, 566 aa, Homo sapiens
EVQLVETGGGLVKPGGSLRLSCSASRFSFRDYYMTWIRQAPGKGPEWVSHISGSGSTIYYADSVRGRFTISRDNAKSSLYLQMDSLQADDTAVYYCARGGRATSYYWVHWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPDVFLFPPKPKDTLMISRTPEVTCVVVDVSHEDPEVKFNWYVDGVEVHNAKTKPREEQYNSTYRVVSVLTVLHQDWLNGKEYKCKVSNAALPAPIAKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNRFTQKSLSLSPGKGGGGSGGGGSGGGGSGGGGSMLPAPKNLVVSRVTEDSARLSWTAPDAAFDSFLIQYQESEKVGEAIVLTVPGSERSYDLTGLKPGTEYTVSIYGVELIYHGWLDFVFSNPLSAIFTT

SEQ ID NO: 901 - protein, 563 aa, Homo sapiens
QVQLVQSGAEVKKPGSSVKVSCKASGGTFSSYAISWVRQAPGQGLEWMGWISAINGNTNYAQKFQGRVTITADESTSTAYMELSSLRSEDTAVYYCARIWNFLLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPDVFLFPPKPKDTLMISRTPEVTCVVVDVSHEDPEVKFNWYVDGVEVHNAKTKPREEQYNSTYRVVSVLTVLHQDWLNGKEYKCKVSNAALPAPIAKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNRFTQKSLSLSPGKGGGGSGGGGSGGGGSGGGGSMLPAPKNLVVSRVTEDSARLSWTAPDAAFDSFLIQYQESEKVGEAIVLTVPGSERSYDLTGLKPGTEYTVSIYGVELIYHGWLDFVFSNPLSAIFTT

SEQ ID NO: 902 - protein, 567 aa, Homo sapiens
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARWSYSQYSGWLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPDVFLFPPKPKDTLMISRTPEVTCVVVDVSHEDPEVKFNWYVDGVEVHNAKTKPREEQYNSTYRVVSVLTVLHQDWLNGKEYKCKVSNAALPAPIAKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNRFTQKSLSLSPGKGGGGSGGGGSGGGGSGGGGSMLPAPKNLVVSRVTEDSARLSWTAPDAAFDSFLIQYQESEKVGEAIVLTVPGSERSYDLTGLKPGTEYTVSIYGVELIYHGWLDFVFSNPLSAIFTT

SEQ ID NO: 903 - protein, 565 aa, Homo sapiens
EVQLVETGGGLVKPGGSLRLSCSASRFSFRDYYMTWIRQAPGKGPEWVSHISGSGSTIYYADSVRGRFTISRDNAKSSLYLQMDSLQADDTAVYYCARGGRATSYYWVHWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPDVFLFPPKPKDTLMISRTPEVTCVVVDVSHEDPEVKFNWYVDGVEVHNAKTKPREEQYNSTYRVVSVLTVLHQDWLNGKEYKCKVSNAALPAPIAKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNRFTQKSLSLSPGKGGGGSGGGGSGGGGSGGGGSLPAPKNLVVSRVTEDSARLSWTAPDAAFDSFLIQYQESEKVGEAIVLTVPGSERSYDLTGLKPGTEYTVSIYGVELIYHGWLDFVFSNPLSAIFTT

SEQ ID NO: 904 - protein, 562 aa, Homo sapiens
QVQLVQSGAEVKKPGSSVKVSCKASGGTFSSYAISWVRQAPGQGLEWMGWISAINGNTNYAQKFQGRVTITADESTSTAYMELSSLRSEDTAVYYCARIWNFLLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPDVFLFPPKPKDTLMISRTPEVTCVVVDVSHEDPEVKFNWYVDGVEVHNAKTKPREEQYNSTYRVVSVLTVLHQDWLNGKEYKCKVSNAALPAPIAKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNRFTQKSLSLSPGKGGGGSGGGGSGGGGSGGGGSLPAPKNLVVSRVTEDSARLSWTAPDAAFDSFLIQYQESEKVGEAIVLTVPGSERSYDLTGLKPGTEYTVSIYGVELIYHGWLDFVFSNPLSAIFTT

SEQ ID NO: 905 - protein, 566 aa, Homo sapiens
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARWSYSQYSGWLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPDVFLFPPKPKDTLMISRTPEVTCVVVDVSHEDPEVKFNWYVDGVEVHNAKTKPREEQYNSTYRVVSVLTVLHQDWLNGKEYKCKVSNAALPAPIAKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNRFTQKSLSLSPGKGGGGSGGGGSGGGGSGGGGSLPAPKNLVVSRVTEDSARLSWTAPDAAFDSFLIQYQESEKVGEAIVLTVPGSERSYDLTGLKPGTEYTVSIYGVELIYHGWLDFVFSNPLSAIFTT

SEQ ID NO: 906 - protein, 676 aa, Homo sapiens
EVQLVETGGGLVKPGGSLRLSCSASRFSFRDYYMTWIRQAPGKGPEWVSHISGSGSTIYYADSVRGRFTISRDNAKSSLYLQMDSLQADDTAVYYCARGGRATSYYWVHWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPDVFLFPPKPKDTLMISRTPEVTCVVVDVSHEDPEVKFNWYVDGVEVHNAKTKPREEQYNSTYRVVSVLTVLHQDWLNGKEYKCKVSNAALPAPIAKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNRFTQKSLSLSPGKGGGGSGGGGSGGGGSGGGGSMLPAPKNLVVSRVTEDSARLSWTAPDAAFDSFWITYEEKFYRGEAIVLTVPGSERSYDLTGLKPGTEYKVWIVGVKGGQGSWPLSAIFTTGGGGSGGGGSGGGGSGGGGSMLPAPKNLVVSRVTEDSARLSWTAPDAAFDSFLIQYQESEKVGEAIVLTVPGSERSYDLTGLKPGTEYTVSIYGVELIYHGWLDFVFSNPLSAIFTT

SEQ ID NO: 907 - protein, 675 aa, Homo sapiens
EVQLVETGGGLVKPGGSLRLSCSASRFSFRDYYMTWIRQAPGKGPEWVSHISGSGSTIYYADSVRGRFTISRDNAKSSLYLQMDSLQADDTAVYYCARGGRATSYYWVHWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPDVFLFPPKPKDTLMISRTPEVTCVVVDVSHEDPEVKFNWYVDGVEVHNAKTKPREEQYNSTYRVVSVLTVLHQDWLNGKEYKCKVSNAALPAPIAKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNRFTQKSLSLSPGKGGGGSGGGGSGGGGSGGGGSMLPAPKNLVVSRVTEDSARLSWTAPDAAFDSFWITYEEKFYRGEAIVLTVPGSERSYDLTGLKPGTEYKVWIVGVKGGQGSWPLSAIFTTGGGGSGGGGSGGGGSGGGGSLPAPKNLVVSRVTEDSARLSWTAPDAAFDSFLIQYQESEKVGEAIVLTVPGSERSYDLTGLKPGTEYTVSIYGVELIYHGWLDFVFSNPLSAIFTT

SEQ ID NO: 908 - protein, 673 aa, Homo sapiens
QVQLVQSGAEVKKPGSSVKVSCKASGGTFSSYAISWVRQAPGQGLEWMGWISAINGNTNYAQKFQGRVTITADESTSTAYMELSSLRSEDTAVYYCARIWNFLLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPDVFLFPPKPKDTLMISRTPEVTCVVVDVSHEDPEVKFNWYVDGVEVHNAKTKPREEQYNSTYRVVSVLTVLHQDWLNGKEYKCKVSNAALPAPIAKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNRFTQKSLSLSPGKGGGGSGGGGSGGGGSGGGGSMLPAPKNLVVSRVTEDSARLSWTAPDAAFDSFWITYEEKFYRGEAIVLTVPGSERSYDLTGLKPGTEYKVWIVGVKGGQGSWPLSAIFTTGGGGSGGGGSGGGGSGGGGSMLPAPKNLVVSRVTEDSARLSWTAPDAAFDSFLIQYQESEKVGEAIVLTVPGSERSYDLTGLKPGTEYTVSIYGVELIYHGWLDFVFSNPLSAIFTT

SEQ ID NO: 909 - protein, 672 aa, Homo sapiens
QVQLVQSGAEVKKPGSSVKVSCKASGGTFSSYAISWVRQAPGQGLEWMGWISAINGNTNYAQKFQGRVTITADESTSTAYMELSSLRSEDTAVYYCARIWNFLLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPDVFLFPPKPKDTLMISRTPEVTCVVVDVSHEDPEVKFNWYVDGVEVHNAKTKPREEQYNSTYRVVSVLTVLHQDWLNGKEYKCKVSNAALPAPIAKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNRFTQKSLSLSPGKGGGGSGGGGSGGGGSGGGGSMLPAPKNLVVSRVTEDSARLSWTAPDAAFDSFWITYEEKFYRGEAIVLTVPGSERSYDLTGLKPGTEYKVWIVGVKGGQGSWPLSAIFTTGGGGSGGGGSGGGGSGGGGSLPAPKNLVVSRVTEDSARLSWTAPDAAFDSFLIQYQESEKVGEAIVLTVPGSERSYDLTGLKPGTEYTVSIYGVELIYHGWLDFVFSNPLSAIFTT

SEQ ID NO: 910 - protein, 677 aa, Homo sapiens
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARWSYSQYSGWLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPDVFLFPPKPKDTLMISRTPEVTCVVVDVSHEDPEVKFNWYVDGVEVHNAKTKPREEQYNSTYRVVSVLTVLHQDWLNGKEYKCKVSNAALPAPIAKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNRFTQKSLSLSPGKGGGGSGGGGSGGGGSGGGGSMLPAPKNLVVSRVTEDSARLSWTAPDAAFDSFWITYEEKFYRGEAIVLTVPGSERSYDLTGLKPGTEYKVWIVGVKGGQGSWPLSAIFTTGGGGSGGGGSGGGGSGGGGSMLPAPKNLVVSRVTEDSARLSWTAPDAAFDSFLIQYQESEKVGEAIVLTVPGSERSYDLTGLKPGTEYTVSIYGVELIYHGWLDFVFSNPLSAIFTT

SEQ ID NO: 911 - protein, 676 aa, Homo sapiens
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARWSYSQYSGWLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPDVFLFPPKPKDTLMISRTPEVTCVVVDVSHEDPEVKFNWYVDGVEVHNAKTKPREEQYNSTYRVVSVLTVLHQDWLNGKEYKCKVSNAALPAPIAKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNRFTQKSLSLSPGKGGGGSGGGGSGGGGSGGGGSMLPAPKNLVVSRVTEDSARLSWTAPDAAFDSFWITYEEKFYRGEAIVLTVPGSERSYDLTGLKPGTEYKVWIVGVKGGQGSWPLSAIFTTGGGGSGGGGSGGGGSGGGGSLPAPKNLVVSRVTEDSARLSWTAPDAAFDSFLIQYQESEKVGEAIVLTVPGSERSYDLTGLKPGTEYTVSIYGVELIYHGWLDFVFSNPLSAIFTT

SEQ ID NO: 912 - protein, 676 aa, Homo sapiens
EVQLVETGGGLVKPGGSLRLSCSASRFSFRDYYMTWIRQAPGKGPEWVSHISGSGSTIYYADSVRGRFTISRDNAKSSLYLQMDSLQADDTAVYYCARGGRATSYYWVHWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPDVFLFPPKPKDTLMISRTPEVTCVVVDVSHEDPEVKFNWYVDGVEVHNAKTKPREEQYNSTYRVVSVLTVLHQDWLNGKEYKCKVSNAALPAPIAKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNRFTQKSLSLSPGKGGGGSGGGGSGGGGSGGGGSMLPAPKNLVVSRVTEDSARLSWTAPDAAFDSFLIQYQESEKVGEAIVLTVPGSERSYDLTGLKPGTEYTVSIYGVELIYHGWLDFVFSNPLSAIFTTGGGGSGGGGSGGGGSGGGGSMLPAPKNLVVSRVTEDSARLSWTAPDAAFDSFWITYEEKFYRGEAIVLTVPGSERSYDLTGLKPGTEYKVWIVGVKGGQGSWPLSAIFTT

SEQ ID NO: 913 - protein, 675 aa, Homo sapiens
EVQLVETGGGLVKPGGSLRLSCSASRFSFRDYYMTWIRQAPGKGPEWVSHISGSGSTIYYADSVRGRFTISRDNAKSSLYLQMDSLQADDTAVYYCARGGRATSYYWVHWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPDVFLFPPKPKDTLMISRTPEVTCVVVDVSHEDPEVKFNWYVDGVEVHNAKTKPREEQYNSTYRVVSVLTVLHQDWLNGKEYKCKVSNAALPAPIAKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNRFTQKSLSLSPGKGGGGSGGGGSGGGGSGGGGSLPAPKNLVVSRVTEDSARLSWTAPDAAFDSFLIQYQESEKVGEAIVLTVPGSERSYDLTGLKPGTEYTVSIYGVELIYHGWLDFVFSNPLSAIFTTGGGGSGGGGSGGGGSGGGGSMLPAPKNLVVSRVTEDSARLSWTAPDAAFDSFWITYEEKFYRGEAIVLTVPGSERSYDLTGLKPGTEYKVWIVGVKGGQGSWPLSAIFTT

SEQ ID NO: 914 - protein, 673 aa, Homo sapiens
QVQLVQSGAEVKKPGSSVKVSCKASGGTFSSYAISWVRQAPGQGLEWMGWISAINGNTNYAQKFQGRVTITADESTSTAYMELSSLRSEDTAVYYCARIWNFLLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPDVFLFPPKPKDTLMISRTPEVTCVVVDVSHEDPEVKFNWYVDGVEVHNAKTKPREEQYNSTYRVVSVLTVLHQDWLNGKEYKCKVSNAALPAPIAKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNRFTQKSLSLSPGKGGGGSGGGGSGGGGSGGGGSMLPAPKNLVVSRVTEDSARLSWTAPDAAFDSFLIQYQESEKVGEAIVLTVPGSERSYDLTGLKPGTEYTVSIYGVELIYHGWLDFVFSNPLSAIFTTGGGGSGGGGSGGGGSGGGGSMLPAPKNLVVSRVTEDSARLSWTAPDAAFDSFWITYEEKFYRGEAIVLTVPGSERSYDLTGLKPGTEYKVWIVGVKGGQGSWPLSAIFTT

SEQ ID NO: 915 - protein, 672 aa, Homo sapiens
QVQLVQSGAEVKKPGSSVKVSCKASGGTFSSYAISWVRQAPGQGLEWMGWISAINGNTNYAQKFQGRVTITADESTSTAYMELSSLRSEDTAVYYCARIWNFLLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPDVFLFPPKPKDTLMISRTPEVTCVVVDVSHEDPEVKFNWYVDGVEVHNAKTKPREEQYNSTYRVVSVLTVLHQDWLNGKEYKCKVSNAALPAPIAKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNRFTQKSLSLSPGKGGGGSGGGGSGGGGSGGGGSLPAPKNLVVSRVTEDSARLSWTAPDAAFDSFLIQYQESEKVGEAIVLTVPGSERSYDLTGLKPGTEYTVSIYGVELIYHGWLDFVFSNPLSAIFTTGGGGSGGGGSGGGGSGGGGSMLPAPKNLVVSRVTEDSARLSWTAPDAAFDSFWITYEEKFYRGEAIVLTVPGSERSYDLTGLKPGTEYKVWIVGVKGGQGSWPLSAIFTT

SEQ ID NO: 916 - protein, 677 aa, Homo sapiens
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARWSYSQYSGWLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPDVFLFPPKPKDTLMISRTPEVTCVVVDVSHEDPEVKFNWYVDGVEVHNAKTKPREEQYNSTYRVVSVLTVLHQDWLNGKEYKCKVSNAALPAPIAKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNRFTQKSLSLSPGKGGGGSGGGGSGGGGSGGGGSMLPAPKNLVVSRVTEDSARLSWTAPDAAFDSFLIQYQESEKVGEAIVLTVPGSERSYDLTGLKPGTEYTVSIYGVELIYHGWLDFVFSNPLSAIFTTGGGGSGGGGSGGGGSGGGGSMLPAPKNLVVSRVTEDSARLSWTAPDAAFDSFWITYEEKFYRGEAIVLTVPGSERSYDLTGLKPGTEYKVWIVGVKGGQGSWPLSAIFTT

SEQ ID NO: 917 - protein, 676 aa, Homo sapiens
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARWSYSQYSGWLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPDVFLFPPKPKDTLMISRTPEVTCVVVDVSHEDPEVKFNWYVDGVEVHNAKTKPREEQYNSTYRVVSVLTVLHQDWLNGKEYKCKVSNAALPAPIAKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNRFTQKSLSLSPGKGGGGSGGGGSGGGGSGGGGSLPAPKNLVVSRVTEDSARLSWTAPDAAFDSFLIQYQESEKVGEAIVLTVPGSERSYDLTGLKPGTEYTVSIYGVELIYHGWLDFVFSNPLSAIFTTGGGGSGGGGSGGGGSGGGGSMLPAPKNLVVSRVTEDSARLSWTAPDAAFDSFWITYEEKFYRGEAIVLTVPGSERSYDLTGLKPGTEYKVWIVGVKGGQGSWPLSAIFTT

SEQ ID NO: 918 - protein, 677 aa, Homo sapiens
EVQLVETGGGLVKPGGSLRLSCSASRFSFRDYYMTWIRQAPGKGPEWVSHISGSGSTIYYADSVRGRFTISRDNAKSSLYLQMDSLQADDTAVYYCARGGRATSYYWVHWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPDVFLFPPKPKDTLMISRTPEVTCVVVDVSHEDPEVKFNWYVDGVEVHNAKTKPREEQYNSTYRVVSVLTVLHQDWLNGKEYKCKVSNAALPAPIAKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNRFTQKSLSLSPGKGGGGSGGGGSGGGGSGGGGSMLPAPKNLVVSRVTEDSARLSWTAPDAAFDSFHIEYAEPWVWGEAIVLTVPGSERSYDLTGLKPGTEYVVFIGGVKGGHNSTPLSAIFTTGGGGSGGGGSGGGGSGGGGSMLPAPKNLVVSRVTEDSARLSWTAPDAAFDSFWITYEEKFYRGEAIVLTVPGSERSYDLTGLKPGTEYKVWIVGVKGGQGSWPLSAIFTTDYKDDDDK

SEQ ID NO: 919 - protein, 679 aa, Homo sapiens
EQKLISEEDLEVQLVETGGGLVKPGGSLRLSCSASRFSFRDYYMTWIRQAPGKGPEWVSHISGSGSTIYYADSVRGRFTISRDNAKSSLYLQMDSLQADDTAVYYCARGGRATSYYWVHWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPDVFLFPPKPKDTLMISRTPEVTCVVVDVSHEDPEVKFNWYVDGVEVHNAKTKPREEQYNSTYRVVSVLTVLHQDWLNGKEYKCKVSNAALPAPIAKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNRFTQKSLSLSPGKGGGGSGGGGSGGGGSGGGGSMLPAPKNLVVSRVTEDSARLSWTAPDAAFDSFHIEYAEPWVWGEAIVLTVPGSERSYDLTGLKPGTEYVVFIGGVKGGHNSTPLSAIFTTGGGGSGGGGSGGGGSGGGGSMLPAPKNLVVSRVTEDSARLSWTAPDAAFDSFWITYEEKFYRGEAIVLTVPGSERSYDLTGLKPGTEYKVWIVGVKGGQGSWPLSAIFTT

SEQ ID NO: 920 - protein, 687 aa, Homo sapiens
EQKLISEEDLEVQLVETGGGLVKPGGSLRLSCSASRFSFRDYYMTWIRQAPGKGPEWVSHISGSGSTIYYADSVRGRFTISRDNAKSSLYLQMDSLQADDTAVYYCARGGRATSYYWVHWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPDVFLFPPKPKDTLMISRTPEVTCVVVDVSHEDPEVKFNWYVDGVEVHNAKTKPREEQYNSTYRVVSVLTVLHQDWLNGKEYKCKVSNAALPAPIAKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNRFTQKSLSLSPGKGGGGSGGGGSGGGGSGGGGSMLPAPKNLVVSRVTEDSARLSWTAPDAAFDSFHIEYAEPWVWGEAIVLTVPGSERSYDLTGLKPGTEYVVFIGGVKGGHNSTPLSAIFTTGGGGSGGGGSGGGGSGGGGSMLPAPKNLVVSRVTEDSARLSWTAPDAAFDSFWITYEEKFYRGEAIVLTVPGSERSYDLTGLKPGTEYKVWIVGVKGGQGSWPLSAIFTTDYKDDDDK

SEQ ID NO: 921 - protein, 675 aa, Homo sapiens
QVQLQESGPGLVKPSETLSLTCTVSGGSIRSSSYYWGWFRQTPGKGLEWLGNVFFSGSAYYNPSLKNRVTISIDTSENQSSLKLTSVTAADTAVYYCARPQAYSHDSSGHSPFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPDVFLFPPKPKDTLMISRTPEVTCVVVDVSHEDPEVKFNWYVDGVEVHNAKTKPREEQYNSTYRVVSVLTVLHQDWLNGKEYKCKVSNAALPAPIAKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNRFTQKSLSLSPGKGGGGSGGGGSGGGGSGGGGSMLPAPKNLVVSRVTEDSARLSWTAPDAAFDSFHIEYAEPWVWGEAIVLTVPGSERSYDLTGLKPGTEYVVFIGGVKGGHNSTPLSAIFTTGGGGSGGGGSGGGGSGGGGSMLPAPKNLVVSRVTEDSARLSWTAPDAAFDSFWITYEEKFYRGEAIVLTVPGSERSYDLTGLKPGTEYKVWIVGVKGGQGSWPLSAIFTT

SEQ ID NO: 922 - protein, 675 aa, Homo sapiens
QVQLQESGPGLVKPSETLSLTCTVSGGSIRSSSYYWGWFRQTPGKGLEWLGNVFFSGSAYYNPSLKNRVTISIDTSENQSSLKLTSVTAADTAVYYCARPQAYSHDSSGHSPFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPDVFLFPPKPKDTLMISRTPEVTCVVVDVSHEDPEVKFNWYVDGVEVHNAKTKPREEQYNSTYRVVSVLTVLHQDWLNGKEYKCKVSNAALPAPIAKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSMLPAPKNLVVSRVTEDSARLSWTAPDAAFDSFHIEYAEPWVWGEAIVLTVPGSERSYDLTGLKPGTEYVVFIGGVKGGHNSTPLSAIFTTGGGGSGGGGSGGGGSGGGGSMLPAPKNLVVSRVTEDSARLSWTAPDAAFDSFWITYEEKFYRGEAIVLTVPGSERSYDLTGLKPGTEYKVWIVGVKGGQGSWPLSAIFTT

SEQ ID NO: 923 - protein, 666 aa, Homo sapiens
QVQLQESGGGVVQPGRSLRLSCAASGFTFSSYGMHWVRQAPGKGLEWVAVISYDGSNKYYADSVKGRFTISRDNSKNTLYLQMNSLRAEDTAVYYCAKNGANAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPDVFLFPPKPKDTLMISRTPEVTCVVVDVSHEDPEVKFNWYVDGVEVHNAKTKPREEQYNSTYRVVSVLTVLHQDWLNGKEYKCKVSNAALPAPIAKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNRFTQKSLSLSPGKGGGGSGGGGSGGGGSGGGGSMLPAPKNLVVSRVTEDSARLSWTAPDAAFDSFHIEYAEPWVWGEAIVLTVPGSERSYDLTGLKPGTEYVVFIGGVKGGHNSTPLSAIFTTGGGGSGGGGSGGGGSGGGGSMLPAPKNLVVSRVTEDSARLSWTAPDAAFDSFWITYEEKFYRGEAIVLTVPGSERSYDLTGLKPGTEYKVWIVGVKGGQGSWPLSAIFTT

SEQ ID NO: 924 - protein, 666 aa, Homo sapiens
QVQLQESGGGVVQPGRSLRLSCAASGFTFSSYGMHWVRQAPGKGLEWVAVISYDGSNKYYADSVKGRFTISRDNSKNTLYLQMNSLRAEDTAVYYCAKNGANAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPDVFLFPPKPKDTLMISRTPEVTCVVVDVSHEDPEVKFNWYVDGVEVHNAKTKPREEQYNSTYRVVSVLTVLHQDWLNGKEYKCKVSNAALPAPIAKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSMLPAPKNLVVSRVTEDSARLSWTAPDAAFDSFHIEYAEPWVWGEAIVLTVPGSERSYDLTGLKPGTEYVVFIGGVKGGHNSTPLSAIFTTGGGGSGGGGSGGGGSGGGGSMLPAPKNLVVSRVTEDSARLSWTAPDAAFDSFWITYEEKFYRGEAIVLTVPGSERSYDLTGLKPGTEYKVWIVGVKGGQGSWPLSAIFTT

SEQ ID NO: 925 - protein, 672 aa, Homo sapiens
EVMLVESGGGLVQPKGSLKLSCAASGFTFNNYAMNWVRQAPGKGLEWVARIRSKSNNYATFYADSVKDRFTISRDDSQSMLYLQMNNLKTEDTAMYYCVRRGASGIDYAMDYWGQGTSLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPDVFLFPPKPKDTLMISRTPEVTCVVVDVSHEDPEVKFNWYVDGVEVHNAKTKPREEQYNSTYRVVSVLTVLHQDWLNGKEYKCKVSNAALPAPIAKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNRFTQKSLSLSPGKGGGGSGGGGSGGGGSGGGGSMLPAPKNLVVSRVTEDSARLSWTAPDAAFDSFHIEYAEPWVWGEAIVLTVPGSERSYDLTGLKPGTEYVVFIGGVKGGHNSTPLSAIFTTGGGGSGGGGSGGGGSGGGGSMLPAPKNLVVSRVTEDSARLSWTAPDAAFDSFWITYEEKFYRGEAIVLTVPGSERSYDLTGLKPGTEYKVWIVGVKGGQGSWPLSAIFTT

SEQ ID NO: 926 - protein, 672 aa, Homo sapiens
EVMLVESGGGLVQPKGSLKLSCAASGFTFNNYAMNWVRQAPGKGLEWVARIRSKSNNYATFYADSVKDRFTISRDDSQSMLYLQMNNLKTEDTAMYYCVRRGASGIDYAMDYWGQGTSLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPDVFLFPPKPKDTLMISRTPEVTCVVVDVSHEDPEVKFNWYVDGVEVHNAKTKPREEQYNSTYRVVSVLTVLHQDWLNGKEYKCKVSNAALPAPIAKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSMLPAPKNLVVSRVTEDSARLSWTAPDAAFDSFHIEYAEPWVWGEAIVLTVPGSERSYDLTGLKPGTEYVVFIGGVKGGHNSTPLSAIFTTGGGGSGGGGSGGGGSGGGGSMLPAPKNLVVSRVTEDSARLSWTAPDAAFDSFWITYEEKFYRGEAIVLTVPGSERSYDLTGLKPGTEYKVWIVGVKGGQGSWPLSAIFTT

SEQ ID NO: 927 - protein, 669 aa, Homo sapiens
QITLKESGPTLVKPTQTLTLTCTFSGFSLSTSGMGVSWIRQPPGKALEWLAHIYWDDDKRYNPSLKSRLTITKDTSKNQVVLTMTNMDPVDTATYYCARLYGFTYGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPDVFLFPPKPKDTLMISRTPEVTCVVVDVSHEDPEVKFNWYVDGVEVHNAKTKPREEQYNSTYRVVSVLTVLHQDWLNGKEYKCKVSNAALPAPIAKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNRFTQKSLSLSPGKGGGGSGGGGSGGGGSGGGGSMLPAPKNLVVSRVTEDSARLSWTAPDAAFDSFHIEYAEPWVWGEAIVLTVPGSERSYDLTGLKPGTEYVVFIGGVKGGHNSTPLSAIFTTGGGGSGGGGSGGGGSGGGGSMLPAPKNLVVSRVTEDSARLSWTAPDAAFDSFWITYEEKFYRGEAIVLTVPGSERSYDLTGLKPGTEYKVWIVGVKGGQGSWPLSAIFTT

SEQ ID NO: 928 - protein, 669 aa, Homo sapiens
QITLKESGPTLVKPTQTLTLTCTFSGFSLSTSGMGVSWIRQPPGKALEWLAHIYWDDDKRYNPSLKSRLTITKDTSKNQVVLTMTNMDPVDTATYYCARLYGFTYGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPDVFLFPPKPKDTLMISRTPEVTCVVVDVSHEDPEVKFNWYVDGVEVHNAKTKPREEQYNSTYRVVSVLTVLHQDWLNGKEYKCKVSNAALPAPIAKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSMLPAPKNLVVSRVTEDSARLSWTAPDAAFDSFHIEYAEPWVWGEAIVLTVPGSERSYDLTGLKPGTEYVVFIGGVKGGHNSTPLSAIFTTGGGGSGGGGSGGGGSGGGGSMLPAPKNLVVSRVTEDSARLSWTAPDAAFDSFWITYEEKFYRGEAIVLTVPGSERSYDLTGLKPGTEYKVWIVGVKGGQGSWPLSAIFTT

SEQ ID NO: 929 - protein, 670 aa, Homo sapiens
EVQLVETGGVAVQPGRSLRLSCAASGFSFRDYGMHWVRQAAGKGLEWVAFIWPHGVNRFYADSMEGRFTISRDDSKNMLYLEMNNLRTEDTALYYCTRDQDYVPRKYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPDVFLFPPKPKDTLMISRTPEVTCVVVDVSHEDPEVKFNWYVDGVEVHNAKTKPREEQYNSTYRVVSVLTVLHQDWLNGKEYKCKVSNAALPAPIAKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNRFTQKSLSLSPGKGGGGSGGGGSGGGGSGGGGSMLPAPKNLVVSRVTEDSARLSWTAPDAAFDSFHIEYAEPWVWGEAIVLTVPGSERSYDLTGLKPGTEYVVFIGGVKGGHNSTPLSAIFTTGGGGSGGGGSGGGGSGGGGSMLPAPKNLVVSRVTEDSARLSWTAPDAAFDSFWITYEEKFYRGEAIVLTVPGSERSYDLTGLKPGTEYKVWIVGVKGGQGSWPLSAIFTT

SEQ ID NO: 930 - protein, 670 aa, Homo sapiens
EVQLVETGGVAVQPGRSLRLSCAASGFSFRDYGMHWVRQAAGKGLEWVAFIWPHGVNRFYADSMEGRFTISRDDSKNMLYLEMNNLRTEDTALYYCTRDQDYVPRKYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPDVFLFPPKPKDTLMISRTPEVTCVVVDVSHEDPEVKFNWYVDGVEVHNAKTKPREEQYNSTYRVVSVLTVLHQDWLNGKEYKCKVSNAALPAPIAKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSMLPAPKNLVVSRVTEDSARLSWTAPDAAFDSFHIEYAEPWVWGEAIVLTVPGSERSYDLTGLKPGTEYVVFIGGVKGGHNSTPLSAIFTTGGGGSGGGGSGGGGSGGGGSMLPAPKNLVVSRVTEDSARLSWTAPDAAFDSFWITYEEKFYRGEAIVLTVPGSERSYDLTGLKPGTEYKVWIVGVKGGQGSWPLSAIFTT

SEQ ID NO: 931 - protein, 629 aa, Homo sapiens
EVQLVETGGGLVKPGGSLRLSCSASRFSFRDYYMTWIRQAPGKGPEWVSHISGSGSTIYYADSVRGRFTISRDNAKSSLYLQMDSLQADDTAVYYCARGGRATSYYWVHWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPDVFLFPPKPKDTLMISRTPEVTCVVVDVSHEDPEVKFNWYVDGVEVHNAKTKPREEQYNSTYRVVSVLTVLHQDWLNGKEYKCKVSNAALPAPIAKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNRFTQKSLSLSPGKMLPAPKNLVVSRVTEDSARLSWTAPDAAFDSFHIEYAEPWVWGEAIVLTVPGSERSYDLTGLKPGTEYVVFIGGVKGGHNSTPLSAIFTTMLPAPKNLVVSRVTEDSARLSWTAPDAAFDSFWITYEEKFYRGEAIVLTVPGSERSYDLTGLKPGTEYKVWIVGVKGGQGSWPLSAIFTT

SEQ ID NO: 932 - protein, 634 aa, Homo sapiens
EVQLVETGGGLVKPGGSLRLSCSASRFSFRDYYMTWIRQAPGKGPEWVSHISGSGSTIYYADSVRGRFTISRDNAKSSLYLQMDSLQADDTAVYYCARGGRATSYYWVHWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPDVFLFPPKPKDTLMISRTPEVTCVVVDVSHEDPEVKFNWYVDGVEVHNAKTKPREEQYNSTYRVVSVLTVLHQDWLNGKEYKCKVSNAALPAPIAKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNRFTQKSLSLSPGKMLPAPKNLVVSRVTEDSARLSWTAPDAAFDSFHIEYAEPWVWGEAIVLTVPGSERSYDLTGLKPGTEYVVFIGGVKGGHNSTPLSAIFTTGGGGSMLPAPKNLVVSRVTEDSARLSWTAPDAAFDSFWITYEEKFYRGEAIVLTVPGSERSYDLTGLKPGTEYKVWIVGVKGGQGSWPLSAIFTT

SEQ ID NO: 933 - protein, 639 aa, Homo sapiens
EVQLVETGGGLVKPGGSLRLSCSASRFSFRDYYMTWIRQAPGKGPEWVSHISGSGSTIYYADSVRGRFTISRDNAKSSLYLQMDSLQADDTAVYYCARGGRATSYYWVHWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPDVFLFPPKPKDTLMISRTPEVTCVVVDVSHEDPEVKFNWYVDGVEVHNAKTKPREEQYNSTYRVVSVLTVLHQDWLNGKEYKCKVSNAALPAPIAKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNRFTQKSLSLSPGKMLPAPKNLVVSRVTEDSARLSWTAPDAAFDSFHIEYAEPWVWGEAIVLTVPGSERSYDLTGLKPGTEYVVFIGGVKGGHNSTPLSAIFTTGGGGSGGGGSMLPAPKNLVVSRVTEDSARLSWTAPDAAFDSFWITYEEKFYRGEAIVLTVPGSERSYDLTGLKPGTEYKVWIVGVKGGQGSWPLSAIFTT

SEQ ID NO: 934 - protein, 644 aa, Homo sapiens
EVQLVETGGGLVKPGGSLRLSCSASRFSFRDYYMTWIRQAPGKGPEWVSHISGSGSTIYYADSVRGRFTISRDNAKSSLYLQMDSLQADDTAVYYCARGGRATSYYWVHWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPDVFLFPPKPKDTLMISRTPEVTCVVVDVSHEDPEVKFNWYVDGVEVHNAKTKPREEQYNSTYRVVSVLTVLHQDWLNGKEYKCKVSNAALPAPIAKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNRFTQKSLSLSPGKMLPAPKNLVVSRVTEDSARLSWTAPDAAFDSFHIEYAEPWVWGEAIVLTVPGSERSYDLTGLKPGTEYVVFIGGVKGGHNSTPLSAIFTTGGGGSGGGGSGGGGSMLPAPKNLVVSRVTEDSARLSWTAPDAAFDSFWITYEEKFYRGEAIVLTVPGSERSYDLTGLKPGTEYKVWIVGVKGGQGSWPLSAIFTT

SEQ ID NO: 935 - protein, 649 aa, Homo sapiens
EVQLVETGGGLVKPGGSLRLSCSASRFSFRDYYMTWIRQAPGKGPEWVSHISGSGSTIYYADSVRGRFTISRDNAKSSLYLQMDSLQADDTAVYYCARGGRATSYYWVHWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPDVFLFPPKPKDTLMISRTPEVTCVVVDVSHEDPEVKFNWYVDGVEVHNAKTKPREEQYNSTYRVVSVLTVLHQDWLNGKEYKCKVSNAALPAPIAKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNRFTQKSLSLSPGKMLPAPKNLVVSRVTEDSARLSWTAPDAAFDSFHIEYAEPWVWGEAIVLTVPGSERSYDLTGLKPGTEYVVFIGGVKGGHNSTPLSAIFTTGGGGSGGGGSGGGGSGGGGSMLPAPKNLVVSRVTEDSARLSWTAPDAAFDSFWITYEEKFYRGEAIVLTVPGSERSYDLTGLKPGTEYKVWIVGVKGGQGSWPLSAIFTT

SEQ ID NO: 936 - protein, 634 aa, Homo sapiens
EVQLVETGGGLVKPGGSLRLSCSASRFSFRDYYMTWIRQAPGKGPEWVSHISGSGSTIYYADSVRGRFTISRDNAKSSLYLQMDSLQADDTAVYYCARGGRATSYYWVHWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPDVFLFPPKPKDTLMISRTPEVTCVVVDVSHEDPEVKFNWYVDGVEVHNAKTKPREEQYNSTYRVVSVLTVLHQDWLNGKEYKCKVSNAALPAPIAKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNRFTQKSLSLSPGKGGGGSMLPAPKNLVVSRVTEDSARLSWTAPDAAFDSFHIEYAEPWVWGEAIVLTVPGSERSYDLTGLKPGTEYVVFIGGVKGGHNSTPLSAIFTTMLPAPKNLVVSRVTEDSARLSWTAPDAAFDSFWITYEEKFYRGEAIVLTVPGSERSYDLTGLKPGTEYKVWIVGVKGGQGSWPLSAIFTT

SEQ ID NO: 937 - protein, 639 aa, Homo sapiens
EVQLVETGGGLVKPGGSLRLSCSASRFSFRDYYMTWIRQAPGKGPEWVSHISGSGSTIYYADSVRGRFTISRDNAKSSLYLQMDSLQADDTAVYYCARGGRATSYYWVHWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPDVFLFPPKPKDTLMISRTPEVTCVVVDVSHEDPEVKFNWYVDGVEVHNAKTKPREEQYNSTYRVVSVLTVLHQDWLNGKEYKCKVSNAALPAPIAKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNRFTQKSLSLSPGKGGGGSMLPAPKNLVVSRVTEDSARLSWTAPDAAFDSFHIEYAEPWVWGEAIVLTVPGSERSYDLTGLKPGTEYVVFIGGVKGGHNSTPLSAIFTTGGGGSMLPAPKNLVVSRVTEDSARLSWTAPDAAFDSFWITYEEKFYRGEAIVLTVPGSERSYDLTGLKPGTEYKVWIVGVKGGQGSWPLSAIFTT

SEQ ID NO: 938 - protein, 644 aa, Homo sapiens
EVQLVETGGGLVKPGGSLRLSCSASRFSFRDYYMTWIRQAPGKGPEWVSHISGSGSTIYYADSVRGRFTISRDNAKSSLYLQMDSLQADDTAVYYCARGGRATSYYWVHWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPDVFLFPPKPKDTLMISRTPEVTCVVVDVSHEDPEVKFNWYVDGVEVHNAKTKPREEQYNSTYRVVSVLTVLHQDWLNGKEYKCKVSNAALPAPIAKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNRFTQKSLSLSPGKGGGGSMLPAPKNLVVSRVTEDSARLSWTAPDAAFDSFHIEYAEPWVWGEAIVLTVPGSERSYDLTGLKPGTEYVVFIGGVKGGHNSTPLSAIFTTGGGGSGGGGSMLPAPKNLVVSRVTEDSARLSWTAPDAAFDSFWITYEEKFYRGEAIVLTVPGSERSYDLTGLKPGTEYKVWIVGVKGGQGSWPLSAIFTT

SEQ ID NO: 939 - protein, 649 aa, Homo sapiens
EVQLVETGGGLVKPGGSLRLSCSASRFSFRDYYMTWIRQAPGKGPEWVSHISGSGSTIYYADSVRGRFTISRDNAKSSLYLQMDSLQADDTAVYYCARGGRATSYYWVHWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPDVFLFPPKPKDTLMISRTPEVTCVVVDVSHEDPEVKFNWYVDGVEVHNAKTKPREEQYNSTYRVVSVLTVLHQDWLNGKEYKCKVSNAALPAPIAKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNRFTQKSLSLSPGKGGGGSMLPAPKNLVVSRVTEDSARLSWTAPDAAFDSFHIEYAEPWVWGEAIVLTVPGSERSYDLTGLKPGTEYVVFIGGVKGGHNSTPLSAIFTTGGGGSGGGGSGGGGSMLPAPKNLVVSRVTEDSARLSWTAPDAAFDSFWITYEEKFYRGEAIVLTVPGSERSYDLTGLKPGTEYKVWIVGVKGGQGSWPLSAIFTT

SEQ ID NO: 940 - protein, 654 aa, Homo sapiens
EVQLVETGGGLVKPGGSLRLSCSASRFSFRDYYMTWIRQAPGKGPEWVSHISGSGSTIYYADSVRGRFTISRDNAKSSLYLQMDSLQADDTAVYYCARGGRATSYYWVHWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPDVFLFPPKPKDTLMISRTPEVTCVVVDVSHEDPEVKFNWYVDGVEVHNAKTKPREEQYNSTYRVVSVLTVLHQDWLNGKEYKCKVSNAALPAPIAKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNRFTQKSLSLSPGKGGGGSMLPAPKNLVVSRVTEDSARLSWTAPDAAFDSFHIEYAEPWVWGEAIVLTVPGSERSYDLTGLKPGTEYVVFIGGVKGGHNSTPLSAIFTTGGGGSGGGGSGGGGSGGGGSMLPAPKNLVVSRVTEDSARLSWTAPDAAFDSFWITYEEKFYRGEAIVLTVPGSERSYDLTGLKPGTEYKVWIVGVKGGQGSWPLSAIFTT

SEQ ID NO: 941 - protein, 639 aa, Homo sapiens
EVQLVETGGGLVKPGGSLRLSCSASRFSFRDYYMTWIRQAPGKGPEWVSHISGSGSTIYYADSVRGRFTISRDNAKSSLYLQMDSLQADDTAVYYCARGGRATSYYWVHWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPDVFLFPPKPKDTLMISRTPEVTCVVVDVSHEDPEVKFNWYVDGVEVHNAKTKPREEQYNSTYRVVSVLTVLHQDWLNGKEYKCKVSNAALPAPIAKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNRFTQKSLSLSPGKGGGGSGGGGSMLPAPKNLVVSRVTEDSARLSWTAPDAAFDSFHIEYAEPWVWGEAIVLTVPGSERSYDLTGLKPGTEYVVFIGGVKGGHNSTPLSAIFTTMLPAPKNLVVSRVTEDSARLSWTAPDAAFDSFWITYEEKFYRGEAIVLTVPGSERSYDLTGLKPGTEYKVWIVGVKGGQGSWPLSAIFTT

SEQ ID NO: 942 - protein, 644 aa, Homo sapiens
EVQLVETGGGLVKPGGSLRLSCSASRFSFRDYYMTWIRQAPGKGPEWVSHISGSGSTIYYADSVRGRFTISRDNAKSSLYLQMDSLQADDTAVYYCARGGRATSYYWVHWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPDVFLFPPKPKDTLMISRTPEVTCVVVDVSHEDPEVKFNWYVDGVEVHNAKTKPREEQYNSTYRVVSVLTVLHQDWLNGKEYKCKVSNAALPAPIAKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNRFTQKSLSLSPGKGGGGSGGGGSMLPAPKNLVVSRVTEDSARLSWTAPDAAFDSFHIEYAEPWVWGEAIVLTVPGSERSYDLTGLKPGTEYVVFIGGVKGGHNSTPLSAIFTTGGGGSMLPAPKNLVVSRVTEDSARLSWTAPDAAFDSFWITYEEKFYRGEAIVLTVPGSERSYDLTGLKPGTEYKVWIVGVKGGQGSWPLSAIFTT

SEQ ID NO: 943 - protein, 649 aa, Homo sapiens
EVQLVETGGGLVKPGGSLRLSCSASRFSFRDYYMTWIRQAPGKGPEWVSHISGSGSTIYYADSVRGRFTISRDNAKSSLYLQMDSLQADDTAVYYCARGGRATSYYWVHWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPDVFLFPPKPKDTLMISRTPEVTCVVVDVSHEDPEVKFNWYVDGVEVHNAKTKPREEQYNSTYRVVSVLTVLHQDWLNGKEYKCKVSNAALPAPIAKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNRFTQKSLSLSPGKGGGGSGGGGSMLPAPKNLVVSRVTEDSARLSWTAPDAAFDSFHIEYAEPWVWGEAIVLTVPGSERSYDLTGLKPGTEYVVFIGGVKGGHNSTPLSAIFTTGGGGSGGGGSMLPAPKNLVVSRVTEDSARLSWTAPDAAFDSFWITYEEKFYRGEAIVLTVPGSERSYDLTGLKPGTEYKVWIVGVKGGQGSWPLSAIFTT

SEQ ID NO: 944 - protein, 654 aa, Homo sapiens
EVQLVETGGGLVKPGGSLRLSCSASRFSFRDYYMTWIRQAPGKGPEWVSHISGSGSTIYYADSVRGRFTISRDNAKSSLYLQMDSLQADDTAVYYCARGGRATSYYWVHWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPDVFLFPPKPKDTLMISRTPEVTCVVVDVSHEDPEVKFNWYVDGVEVHNAKTKPREEQYNSTYRVVSVLTVLHQDWLNGKEYKCKVSNAALPAPIAKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNRFTQKSLSLSPGKGGGGSGGGGSMLPAPKNLVVSRVTEDSARLSWTAPDAAFDSFHIEYAEPWVWGEAIVLTVPGSERSYDLTGLKPGTEYVVFIGGVKGGHNSTPLSAIFTTGGGGSGGGGSGGGGSMLPAPKNLVVSRVTEDSARLSWTAPDAAFDSFWITYEEKFYRGEAIVLTVPGSERSYDLTGLKPGTEYKVWIVGVKGGQGSWPLSAIFTT

SEQ ID NO: 945 - protein, 659 aa, Homo sapiens
EVQLVETGGGLVKPGGSLRLSCSASRFSFRDYYMTWIRQAPGKGPEWVSHISGSGSTIYYADSVRGRFTISRDNAKSSLYLQMDSLQADDTAVYYCARGGRATSYYWVHWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPDVFLFPPKPKDTLMISRTPEVTCVVVDVSHEDPEVKFNWYVDGVEVHNAKTKPREEQYNSTYRVVSVLTVLHQDWLNGKEYKCKVSNAALPAPIAKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNRFTQKSLSLSPGKGGGGSGGGGSMLPAPKNLVVSRVTEDSARLSWTAPDAAFDSFHIEYAEPWVWGEAIVLTVPGSERSYDLTGLKPGTEYVVFIGGVKGGHNSTPLSAIFTTGGGGSGGGGSGGGGSGGGGSMLPAPKNLVVSRVTEDSARLSWTAPDAAFDSFWITYEEKFYRGEAIVLTVPGSERSYDLTGLKPGTEYKVWIVGVKGGQGSWPLSAIFTT

SEQ ID NO: 946 - protein, 644 aa, Homo sapiens
EVQLVETGGGLVKPGGSLRLSCSASRFSFRDYYMTWIRQAPGKGPEWVSHISGSGSTIYYADSVRGRFTISRDNAKSSLYLQMDSLQADDTAVYYCARGGRATSYYWVHWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPDVFLFPPKPKDTLMISRTPEVTCVVVDVSHEDPEVKFNWYVDGVEVHNAKTKPREEQYNSTYRVVSVLTVLHQDWLNGKEYKCKVSNAALPAPIAKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNRFTQKSLSLSPGKGGGGSGGGGSGGGGSMLPAPKNLVVSRVTEDSARLSWTAPDAAFDSFHIEYAEPWVWGEAIVLTVPGSERSYDLTGLKPGTEYVVFIGGVKGGHNSTPLSAIFTTMLPAPKNLVVSRVTEDSARLSWTAPDAAFDSFWITYEEKFYRGEAIVLTVPGSERSYDLTGLKPGTEYKVWIVGVKGGQGSWPLSAIFTT

SEQ ID NO: 947 - protein, 649 aa, Homo sapiens
EVQLVETGGGLVKPGGSLRLSCSASRFSFRDYYMTWIRQAPGKGPEWVSHISGSGSTIYYADSVRGRFTISRDNAKSSLYLQMDSLQADDTAVYYCARGGRATSYYWVHWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPDVFLFPPKPKDTLMISRTPEVTCVVVDVSHEDPEVKFNWYVDGVEVHNAKTKPREEQYNSTYRVVSVLTVLHQDWLNGKEYKCKVSNAALPAPIAKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNRFTQKSLSLSPGKGGGGSGGGGSGGGGSMLPAPKNLVVSRVTEDSARLSWTAPDAAFDSFHIEYAEPWVWGEAIVLTVPGSERSYDLTGLKPGTEYVVFIGGVKGGHNSTPLSAIFTTGGGGSMLPAPKNLVVSRVTEDSARLSWTAPDAAFDSFWITYEEKFYRGEAIVLTVPGSERSYDLTGLKPGTEYKVWIVGVKGGQGSWPLSAIFTT

SEQ ID NO: 948 - protein, 654 aa, Homo sapiens
EVQLVETGGGLVKPGGSLRLSCSASRFSFRDYYMTWIRQAPGKGPEWVSHISGSGSTIYYADSVRGRFTISRDNAKSSLYLQMDSLQADDTAVYYCARGGRATSYYWVHWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPDVFLFPPKPKDTLMISRTPEVTCVVVDVSHEDPEVKFNWYVDGVEVHNAKTKPREEQYNSTYRVVSVLTVLHQDWLNGKEYKCKVSNAALPAPIAKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNRFTQKSLSLSPGKGGGGSGGGGSGGGGSMLPAPKNLVVSRVTEDSARLSWTAPDAAFDSFHIEYAEPWVWGEAIVLTVPGSERSYDLTGLKPGTEYVVFIGGVKGGHNSTPLSAIFTTGGGGSGGGGSMLPAPKNLVVSRVTEDSARLSWTAPDAAFDSFWITYEEKFYRGEAIVLTVPGSERSYDLTGLKPGTEYKVWIVGVKGGQGSWPLSAIFTT

SEQ ID NO: 949 - protein, 659 aa, Homo sapiens
EVQLVETGGGLVKPGGSLRLSCSASRFSFRDYYMTWIRQAPGKGPEWVSHISGSGSTIYYADSVRGRFTISRDNAKSSLYLQMDSLQADDTAVYYCARGGRATSYYWVHWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPDVFLFPPKPKDTLMISRTPEVTCVVVDVSHEDPEVKFNWYVDGVEVHNAKTKPREEQYNSTYRVVSVLTVLHQDWLNGKEYKCKVSNAALPAPIAKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNRFTQKSLSLSPGKGGGGSGGGGSGGGGSMLPAPKNLVVSRVTEDSARLSWTAPDAAFDSFHIEYAEPWVWGEAIVLTVPGSERSYDLTGLKPGTEYVVFIGGVKGGHNSTPLSAIFTTGGGGSGGGGSGGGGSMLPAPKNLVVSRVTEDSARLSWTAPDAAFDSFWITYEEKFYRGEAIVLTVPGSERSYDLTGLKPGTEYKVWIVGVKGGQGSWPLSAIFTT

SEQ ID NO: 950 - protein, 664 aa, Homo sapiens
EVQLVETGGGLVKPGGSLRLSCSASRFSFRDYYMTWIRQAPGKGPEWVSHISGSGSTIYYADSVRGRFTISRDNAKSSLYLQMDSLQADDTAVYYCARGGRATSYYWVHWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPDVFLFPPKPKDTLMISRTPEVTCVVVDVSHEDPEVKFNWYVDGVEVHNAKTKPREEQYNSTYRVVSVLTVLHQDWLNGKEYKCKVSNAALPAPIAKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNRFTQKSLSLSPGKGGGGSGGGGSGGGGSMLPAPKNLVVSRVTEDSARLSWTAPDAAFDSFHIEYAEPWVWGEAIVLTVPGSERSYDLTGLKPGTEYVVFIGGVKGGHNSTPLSAIFTTGGGGSGGGGSGGGGSGGGGSMLPAPKNLVVSRVTEDSARLSWTAPDAAFDSFWITYEEKFYRGEAIVLTVPGSERSYDLTGLKPGTEYKVWIVGVKGGQGSWPLSAIFTT

SEQ ID NO: 951 - protein, 649 aa, Homo sapiens
EVQLVETGGGLVKPGGSLRLSCSASRFSFRDYYMTWIRQAPGKGPEWVSHISGSGSTIYYADSVRGRFTISRDNAKSSLYLQMDSLQADDTAVYYCARGGRATSYYWVHWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPDVFLFPPKPKDTLMISRTPEVTCVVVDVSHEDPEVKFNWYVDGVEVHNAKTKPREEQYNSTYRVVSVLTVLHQDWLNGKEYKCKVSNAALPAPIAKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNRFTQKSLSLSPGKGGGGSGGGGSGGGGSGGGGSMLPAPKNLVVSRVTEDSARLSWTAPDAAFDSFHIEYAEPWVWGEAIVLTVPGSERSYDLTGLKPGTEYVVFIGGVKGGHNSTPLSAIFTTMLPAPKNLVVSRVTEDSARLSWTAPDAAFDSFWITYEEKFYRGEAIVLTVPGSERSYDLTGLKPGTEYKVWIVGVKGGQGSWPLSAIFTT

SEQ ID NO: 952 - protein, 654 aa, Homo sapiens
EVQLVETGGGLVKPGGSLRLSCSASRFSFRDYYMTWIRQAPGKGPEWVSHISGSGSTIYYADSVRGRFTISRDNAKSSLYLQMDSLQADDTAVYYCARGGRATSYYWVHWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPDVFLFPPKPKDTLMISRTPEVTCVVVDVSHEDPEVKFNWYVDGVEVHNAKTKPREEQYNSTYRVVSVLTVLHQDWLNGKEYKCKVSNAALPAPIAKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNRFTQKSLSLSPGKGGGGSGGGGSGGGGSGGGGSMLPAPKNLVVSRVTEDSARLSWTAPDAAFDSFHIEYAEPWVWGEAIVLTVPGSERSYDLTGLKPGTEYVVFIGGVKGGHNSTPLSAIFTTGGGGSMLPAPKNLVVSRVTEDSARLSWTAPDAAFDSFWITYEEKFYRGEAIVLTVPGSERSYDLTGLKPGTEYKVWIVGVKGGQGSWPLSAIFTT

SEQ ID NO: 953 - protein, 659 aa, Homo sapiens
EVQLVETGGGLVKPGGSLRLSCSASRFSFRDYYMTWIRQAPGKGPEWVSHISGSGSTIYYADSVRGRFTISRDNAKSSLYLQMDSLQADDTAVYYCARGGRATSYYWVHWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPDVFLFPPKPKDTLMISRTPEVTCVVVDVSHEDPEVKFNWYVDGVEVHNAKTKPREEQYNSTYRVVSVLTVLHQDWLNGKEYKCKVSNAALPAPIAKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNRFTQKSLSLSPGKGGGGSGGGGSGGGGSGGGGSMLPAPKNLVVSRVTEDSARLSWTAPDAAFDSFHIEYAEPWVWGEAIVLTVPGSERSYDLTGLKPGTEYVVFIGGVKGGHNSTPLSAIFTTGGGGSGGGGSMLPAPKNLVVSRVTEDSARLSWTAPDAAFDSFWITYEEKFYRGEAIVLTVPGSERSYDLTGLKPGTEYKVWIVGVKGGQGSWPLSAIFTT

SEQ ID NO: 954 - protein, 664 aa, Homo sapiens
EVQLVETGGGLVKPGGSLRLSCSASRFSFRDYYMTWIRQAPGKGPEWVSHISGSGSTIYYADSVRGRFTISRDNAKSSLYLQMDSLQADDTAVYYCARGGRATSYYWVHWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPDVFLFPPKPKDTLMISRTPEVTCVVVDVSHEDPEVKFNWYVDGVEVHNAKTKPREEQYNSTYRVVSVLTVLHQDWLNGKEYKCKVSNAALPAPIAKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNRFTQKSLSLSPGKGGGGSGGGGSGGGGSGGGGSMLPAPKNLVVSRVTEDSARLSWTAPDAAFDSFHIEYAEPWVWGEAIVLTVPGSERSYDLTGLKPGTEYVVFIGGVKGGHNSTPLSAIFTTGGGGSGGGGSGGGGSMLPAPKNLVVSRVTEDSARLSWTAPDAAFDSFWITYEEKFYRGEAIVLTVPGSERSYDLTGLKPGTEYKVWIVGVKGGQGSWPLSAIFTT

SEQ ID NO: 955 - protein, 668 aa, Homo sapiens
EVQLVETGGGLVKPGGSLRLSCSASRFSFRDYYMTWIRQAPGKGPEWVSHISGSGSTIYYADSVRGRFTISRDNAKSSLYLQMDSLQADDTAVYYCARGGRATSYYWVHWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPDVFLFPPKPKDTLMISRTPEVTCVVVDVSHEDPEVKFNWYVDGVEVHNAKTKPREEQYNSTYRVVSVLTVLHQDWLNGKEYKCKVSNAALPAPIAKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNRFTQKSLSLSPGGGGGSGGGGSGGGGSGGGGSMLPAPKNLVVSRVTEDSARLSWTAPDAAFDSFPIVYQEWQFYGEAIVLTVPGSERSYDLTGLKPGTEYLVDIYGVKGGSWSYPLSAIFTTGGGGSGGGGSGGGGSGGGGSMLPAPKNLVVSRVTEDSARLSWTAPDAAFDSFWITYEEKFYRGEAIVLTVPGSERSYDLTGLKPGTEYKVWIVGVKGGQGSWPLSAIFTT

SEQ ID NO: 956 - protein, 668 aa, Homo sapiens
EVQLVETGGGLVKPGGSLRLSCSASRFSFRDYYMTWIRQAPGKGPEWVSHISGSGSTIYYADSVRGRFTISRDNAKSSLYLQMDSLQADDTAVYYCARGGRATSYYWVHWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPDVFLFPPKPKDTLMISRTPEVTCVVVDVSHEDPEVKFNWYVDGVEVHNAKTKPREEQYNSTYRVVSVLTVLHQDWLNGKEYKCKVSNAALPAPIAKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGGGSMLPAPKNLVVSRVTEDSARLSWTAPDAAFDSFPIVYQEWQFYGEAIVLTVPGSERSYDLTGLKPGTEYLVDIYGVKGGSWSYPLSAIFTTGGGGSGGGGSGGGGSGGGGSMLPAPKNLVVSRVTEDSARLSWTAPDAAFDSFWITYEEKFYRGEAIVLTVPGSERSYDLTGLKPGTEYKVWIVGVKGGQGSWPLSAIFTT

SEQ ID NO: 957 - protein, 667 aa, Homo sapiens
QITLKESGPTLVKPTQTLTLTCTFSGFSLSTSGMGVSWIRQPPGKALEWLAHIYWDDDKRYNPSLKSRLTITKDTSKNQVVLTMTNMDPVDTATYYCARLYGFTYGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPDVFLFPPKPKDTLMISRTPEVTCVVVDVSHEDPEVKFNWYVDGVEVHNAKTKPREEQYNSTYRVVSVLTVLHQDWLNGKEYKCKVSNAALPAPIAKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSLPAPKNLVVSRVTEDSARLSWTAPDAAFDSFLIQYQESEKVGEAIVLTVPGSERSYDLTGLKPGTEYTVSIYGVKGGHRSNPLSAIFTTGGGGSGGGGSGGGGSGGGGSLPAPKNLVVSRVTEDSARLSWTAPDAAFDSFLIQYQESEKVGEAIVLTVPGSERSYDLTGLKPGTEYTVSIYGVKGGHRSNPLSAIFTT

SEQ ID NO: 958 - protein, 669 aa, Homo sapiens
QITLKESGPTLVKPTQTLTLTCTFSGFSLSTSGMGVSWIRQPPGKALEWLAHIYWDDDKRYNPSLKSRLTITKDTSKNQVVLTMTNMDPVDTATYYCARLYGFTYGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPDVFLFPPKPKDTLMISRTPEVTCVVVDVSHEDPEVKFNWYVDGVEVHNAKTKPREEQYNSTYRVVSVLTVLHQDWLNGKEYKCKVSNAALPAPIAKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSMLPAPKNLVVSRVTEDSARLSWTAPDAAFDSFLIQYQESEKVGEAIVLTVPGSERSYDLTGLKPGTEYTVSIYGVKGGHRSNPLSAIFTTGGGGSGGGGSGGGGSGGGGSMLPAPKNLVVSRVTEDSARLSWTAPDAAFDSFLIQYQESEKVGEAIVLTVPGSERSYDLTGLKPGTEYTVSIYGVKGGHRSNPLSAIFTT

SEQ ID NO: 959 - protein, 668 aa, Homo sapiens
QITLKESGPTLVKPTQTLTLTCTFSGFSLSTSGMGVSWIRQPPGKALEWLAHIYWDDDKRYNPSLKSRLTITKDTSKNQVVLTMTNMDPVDTATYYCARLYGFTYGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSLPAPKNLVVSRVTEDSARLSWTAPDAAFDSFLIQYQESEKVGEAIVLTVPGSERSYDLTGLKPGTEYTVSIYGVKGGHRSNPLSAIFTTGGGGSGGGGSGGGGSGGGGSLPAPKNLVVSRVTEDSARLSWTAPDAAFDSFLIQYQESEKVGEAIVLTVPGSERSYDLTGLKPGTEYTVSIYGVKGGHRSNPLSAIFTT

SEQ ID NO: 960 - protein, 670 aa, Homo sapiens
QITLKESGPTLVKPTQTLTLTCTFSGFSLSTSGMGVSWIRQPPGKALEWLAHIYWDDDKRYNPSLKSRLTITKDTSKNQVVLTMTNMDPVDTATYYCARLYGFTYGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSMLPAPKNLVVSRVTEDSARLSWTAPDAAFDSFLIQYQESEKVGEAIVLTVPGSERSYDLTGLKPGTEYTVSIYGVKGGHRSNPLSAIFTTGGGGSGGGGSGGGGSGGGGSMLPAPKNLVVSRVTEDSARLSWTAPDAAFDSFLIQYQESEKVGEAIVLTVPGSERSYDLTGLKPGTEYTVSIYGVKGGHRSNPLSAIFTT

SEQ ID NO: 961 - protein, 670 aa, Homo sapiens
EVQLVETGGGLVKPGGSLRLSCSASRFSFRDYYMTWIRQAPGKGPEWVSHISGSGSTIYYADSVRGRFTISRDNAKSSLYLQMDSLQADDTAVYYCARGGRATSYYWVHWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNRFTQKSLSLSPGKGGGGSGGGGSGGGGSGGGGSMLPAPKNLVVSRVTEDSARLSWTAPDAAFDSFHIEYAEPWVWGEAIVLTVPGSERSYDLTGLKPGTEYVVFIGGVKGGHNSTPLSAIFTTGGGGSGGGGSGGGGSGGGGSMLPAPKNLVVSRVTEDSARLSWTAPDAAFDSFWITYEEKFYRGEAIVLTVPGSERSYDLTGLKPGTEYKVWIVGVKGGQGSWPLSAIFTT

SEQ ID NO: 962 - protein, 670 aa, Homo sapiens
EVQLVETGGGLVKPGGSLRLSCSASRFSFRDYYMTWIRQAPGKGPEWVSHISGSGSTIYYADSVRGRFTISRDNAKSSLYLQMDSLQADDTAVYYCARGGRATSYYWVHWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSMLPAPKNLVVSRVTEDSARLSWTAPDAAFDSFHIEYAEPWVWGEAIVLTVPGSERSYDLTGLKPGTEYVVFIGGVKGGHNSTPLSAIFTTGGGGSGGGGSGGGGSGGGGSMLPAPKNLVVSRVTEDSARLSWTAPDAAFDSFWITYEEKFYRGEAIVLTVPGSERSYDLTGLKPGTEYKVWIVGVKGGQGSWPLSAIFTT

SEQ ID NO: 963 - protein, 654 aa, Homo sapiens
EVQLVETGGGLVKPGGSLRLSCSASRFSFRDYYMTWIRQAPGKGPEWVSHISGSGSTIYYADSVRGRFTISRDNAKSSLYLQMDSLQADDTAVYYCARGGRATSYYWVHWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPDVFLFPPKPKDTLMISRTPEVTCVVVDVSHEDPEVKFNWYVDGVEVHNAKTKPREEQYNSTYRVVSVLTVLHQDWLNGKEYKCKVSNAALPAPIAKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSMLPAPKNLVVSRVTEDSARLSWTAPDAAFDSFHIEYAEPWVWGEAIVLTVPGSERSYDLTGLKPGTEYVVFIGGVKGGHNSTPLSAIFTTGGGGSMLPAPKNLVVSRVTEDSARLSWTAPDAAFDSFWITYEEKFYRGEAIVLTVPGSERSYDLTGLKPGTEYKVWIVGVKGGQGSWPLSAIFTT

SEQ ID NO: 964 - protein, 664 aa, Homo sapiens
EQKLISEEDLEVQLVETGGGLVKPGGSLRLSCSASRFSFRDYYMTWIRQAPGKGPEWVSHISGSGSTIYYADSVRGRFTISRDNAKSSLYLQMDSLQADDTAVYYCARGGRATSYYWVHWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPDVFLFPPKPKDTLMISRTPEVTCVVVDVSHEDPEVKFNWYVDGVEVHNAKTKPREEQYNSTYRVVSVLTVLHQDWLNGKEYKCKVSNAALPAPIAKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSMLPAPKNLVVSRVTEDSARLSWTAPDAAFDSFHIEYAEPWVWGEAIVLTVPGSERSYDLTGLKPGTEYVVFIGGVKGGHNSTPLSAIFTTGGGGSMLPAPKNLVVSRVTEDSARLSWTAPDAAFDSFWITYEEKFYRGEAIVLTVPGSERSYDLTGLKPGTEYKVWIVGVKGGQGSWPLSAIFTT

SEQ ID NO: 965 - protein, 662 aa, Homo sapiens
EVQLVETGGGLVKPGGSLRLSCSASRFSFRDYYMTWIRQAPGKGPEWVSHISGSGSTIYYADSVRGRFTISRDNAKSSLYLQMDSLQADDTAVYYCARGGRATSYYWVHWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPDVFLFPPKPKDTLMISRTPEVTCVVVDVSHEDPEVKFNWYVDGVEVHNAKTKPREEQYNSTYRVVSVLTVLHQDWLNGKEYKCKVSNAALPAPIAKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSMLPAPKNLVVSRVTEDSARLSWTAPDAAFDSFHIEYAEPWVWGEAIVLTVPGSERSYDLTGLKPGTEYVVFIGGVKGGHNSTPLSAIFTTGGGGSMLPAPKNLVVSRVTEDSARLSWTAPDAAFDSFWITYEEKFYRGEAIVLTVPGSERSYDLTGLKPGTEYKVWIVGVKGGQGSWPLSAIFTTDYKDDDDK

SEQ ID NO: 966 - protein, 672 aa, Homo sapiens
EQKLISEEDLEVQLVETGGGLVKPGGSLRLSCSASRFSFRDYYMTWIRQAPGKGPEWVSHISGSGSTIYYADSVRGRFTISRDNAKSSLYLQMDSLQADDTAVYYCARGGRATSYYWVHWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPDVFLFPPKPKDTLMISRTPEVTCVVVDVSHEDPEVKFNWYVDGVEVHNAKTKPREEQYNSTYRVVSVLTVLHQDWLNGKEYKCKVSNAALPAPIAKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSMLPAPKNLVVSRVTEDSARLSWTAPDAAFDSFHIEYAEPWVWGEAIVLTVPGSERSYDLTGLKPGTEYVVFIGGVKGGHNSTPLSAIFTTGGGGSMLPAPKNLVVSRVTEDSARLSWTAPDAAFDSFWITYEEKFYRGEAIVLTVPGSERSYDLTGLKPGTEYKVWIVGVKGGQGSWPLSAIFTTDYKDDDDK

SEQ ID NO: 967 - protein, 664 aa, Homo sapiens
EQKLISEEDLEVQLVETGGGLVKPGGSLRLSCSASRFSFRDYYMTWIRQAPGKGPEWVSHISGSGSTIYYADSVRGRFTISRDNAKSSLYLQMDSLQADDTAVYYCARGGRATSYYWVHWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPDVFLFPPKPKDTLMISRTPEVTCVVVDVSHEDPEVKFNWYVDGVEVHNAKTKPREEQYNSTYRVVSVLTVLHQDWLNGKEYKCKVSNAALPAPIAKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNRFTQKSLSLSPGKGGGGSGGGGSGGGGSGGGGSMLPAPKNLVVSRVTEDSARLSWTAPDAAFDSFHIEYAEPWVWGEAIVLTVPGSERSYDLTGLKPGTEYVVFIGGVKGGHNSTPLSAIFTTGGGGSMLPAPKNLVVSRVTEDSARLSWTAPDAAFDSFWITYEEKFYRGEAIVLTVPGSERSYDLTGLKPGTEYKVWIVGVKGGQGSWPLSAIFTT

SEQ ID NO: 968 - protein, 662 aa, Homo sapiens
EVQLVETGGGLVKPGGSLRLSCSASRFSFRDYYMTWIRQAPGKGPEWVSHISGSGSTIYYADSVRGRFTISRDNAKSSLYLQMDSLQADDTAVYYCARGGRATSYYWVHWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPDVFLFPPKPKDTLMISRTPEVTCVVVDVSHEDPEVKFNWYVDGVEVHNAKTKPREEQYNSTYRVVSVLTVLHQDWLNGKEYKCKVSNAALPAPIAKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNRFTQKSLSLSPGKGGGGSGGGGSGGGGSGGGGSMLPAPKNLVVSRVTEDSARLSWTAPDAAFDSFHIEYAEPWVWGEAIVLTVPGSERSYDLTGLKPGTEYVVFIGGVKGGHNSTPLSAIFTTGGGGSMLPAPKNLVVSRVTEDSARLSWTAPDAAFDSFWITYEEKFYRGEAIVLTVPGSERSYDLTGLKPGTEYKVWIVGVKGGQGSWPLSAIFTTDYKDDDDK

SEQ ID NO: 969 - protein, 679 aa, Homo sapiens
EQKLISEEDLEVQLVETGGGLVKPGGSLRLSCSASRFSFRDYYMTWIRQAPGKGPEWVSHISGSGSTIYYADSVRGRFTISRDNAKSSLYLQMDSLQADDTAVYYCARGGRATSYYWVHWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPDVFLFPPKPKDTLMISRTPEVTCVVVDVSHEDPEVKFNWYVDGVEVHNAKTKPREEQYNSTYRVVSVLTVLHQDWLNGKEYKCKVSNAALPAPIAKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSMLPAPKNLVVSRVTEDSARLSWTAPDAAFDSFHIEYAEPWVWGEAIVLTVPGSERSYDLTGLKPGTEYVVFIGGVKGGHNSTPLSAIFTTGGGGSGGGGSGGGGSGGGGSMLPAPKNLVVSRVTEDSARLSWTAPDAAFDSFWITYEEKFYRGEAIVLTVPGSERSYDLTGLKPGTEYKVWIVGVKGGQGSWPLSAIFTT

SEQ ID NO: 970 - protein, 677 aa, Homo sapiens
EVQLVETGGGLVKPGGSLRLSCSASRFSFRDYYMTWIRQAPGKGPEWVSHISGSGSTIYYADSVRGRFTISRDNAKSSLYLQMDSLQADDTAVYYCARGGRATSYYWVHWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPDVFLFPPKPKDTLMISRTPEVTCVVVDVSHEDPEVKFNWYVDGVEVHNAKTKPREEQYNSTYRVVSVLTVLHQDWLNGKEYKCKVSNAALPAPIAKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSMLPAPKNLVVSRVTEDSARLSWTAPDAAFDSFHIEYAEPWVWGEAIVLTVPGSERSYDLTGLKPGTEYVVFIGGVKGGHNSTPLSAIFTTGGGGSGGGGSGGGGSGGGGSMLPAPKNLVVSRVTEDSARLSWTAPDAAFDSFWITYEEKFYRGEAIVLTVPGSERSYDLTGLKPGTEYKVWIVGVKGGQGSWPLSAIFTTDYKDDDDK

SEQ ID NO: 971 - protein, 687 aa, Homo sapiens
EQKLISEEDLEVQLVETGGGLVKPGGSLRLSCSASRFSFRDYYMTWIRQAPGKGPEWVSHISGSGSTIYYADSVRGRFTISRDNAKSSLYLQMDSLQADDTAVYYCARGGRATSYYWVHWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPDVFLFPPKPKDTLMISRTPEVTCVVVDVSHEDPEVKFNWYVDGVEVHNAKTKPREEQYNSTYRVVSVLTVLHQDWLNGKEYKCKVSNAALPAPIAKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSMLPAPKNLVVSRVTEDSARLSWTAPDAAFDSFHIEYAEPWVWGEAIVLTVPGSERSYDLTGLKPGTEYVVFIGGVKGGHNSTPLSAIFTTGGGGSGGGGSGGGGSGGGGSMLPAPKNLVVSRVTEDSARLSWTAPDAAFDSFWITYEEKFYRGEAIVLTVPGSERSYDLTGLKPGTEYKVWIVGVKGGQGSWPLSAIFTTDYKDDDDK

SEQ ID NO: 972 - protein, 672 aa, Homo sapiens
EQKLISEEDLEVQLVETGGGLVKPGGSLRLSCSASRFSFRDYYMTWIRQAPGKGPEWVSHISGSGSTIYYADSVRGRFTISRDNAKSSLYLQMDSLQADDTAVYYCARGGRATSYYWVHWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPDVFLFPPKPKDTLMISRTPEVTCVVVDVSHEDPEVKFNWYVDGVEVHNAKTKPREEQYNSTYRVVSVLTVLHQDWLNGKEYKCKVSNAALPAPIAKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNRFTQKSLSLSPGKGGGGSGGGGSGGGGSGGGGSMLPAPKNLVVSRVTEDSARLSWTAPDAAFDSFHIEYAEPWVWGEAIVLTVPGSERSYDLTGLKPGTEYVVFIGGVKGGHNSTPLSAIFTTGGGGSMLPAPKNLVVSRVTEDSARLSWTAPDAAFDSFWITYEEKFYRGEAIVLTVPGSERSYDLTGLKPGTEYKVWIVGVKGGQGSWPLSAIFTTDYKDDDDK

SEQ ID NO: 973 - protein, 677 aa, Homo sapiens
DYKDDDDKEVQLVETGGGLVKPGGSLRLSCSASRFSFRDYYMTWIRQAPGKGPEWVSHISGSGSTIYYADSVRGRFTISRDNAKSSLYLQMDSLQADDTAVYYCARGGRATSYYWVHWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPDVFLFPPKPKDTLMISRTPEVTCVVVDVSHEDPEVKFNWYVDGVEVHNAKTKPREEQYNSTYRVVSVLTVLHQDWLNGKEYKCKVSNAALPAPIAKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNRFTQKSLSLSPGKGGGGSGGGGSGGGGSGGGGSMLPAPKNLVVSRVTEDSARLSWTAPDAAFDSFHIEYAEPWVWGEAIVLTVPGSERSYDLTGLKPGTEYVVFIGGVKGGHNSTPLSAIFTTGGGGSGGGGSGGGGSGGGGSMLPAPKNLVVSRVTEDSARLSWTAPDAAFDSFWITYEEKFYRGEAIVLTVPGSERSYDLTGLKPGTEYKVWIVGVKGGQGSWPLSAIFTT

SEQ ID NO: 974 - protein, 677 aa, Homo sapiens
DYKDDDDKEVQLVETGGGLVKPGGSLRLSCSASRFSFRDYYMTWIRQAPGKGPEWVSHISGSGSTIYYADSVRGRFTISRDNAKSSLYLQMDSLQADDTAVYYCARGGRATSYYWVHWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPDVFLFPPKPKDTLMISRTPEVTCVVVDVSHEDPEVKFNWYVDGVEVHNAKTKPREEQYNSTYRVVSVLTVLHQDWLNGKEYKCKVSNAALPAPIAKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSMLPAPKNLVVSRVTEDSARLSWTAPDAAFDSFHIEYAEPWVWGEAIVLTVPGSERSYDLTGLKPGTEYVVFIGGVKGGHNSTPLSAIFTTGGGGSGGGGSGGGGSGGGGSMLPAPKNLVVSRVTEDSARLSWTAPDAAFDSFWITYEEKFYRGEAIVLTVPGSERSYDLTGLKPGTEYKVWIVGVKGGQGSWPLSAIFTT

SEQ ID NO: 975 - protein, 662 aa, Homo sapiens
DYKDDDDKEVQLVETGGGLVKPGGSLRLSCSASRFSFRDYYMTWIRQAPGKGPEWVSHISGSGSTIYYADSVRGRFTISRDNAKSSLYLQMDSLQADDTAVYYCARGGRATSYYWVHWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPDVFLFPPKPKDTLMISRTPEVTCVVVDVSHEDPEVKFNWYVDGVEVHNAKTKPREEQYNSTYRVVSVLTVLHQDWLNGKEYKCKVSNAALPAPIAKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNRFTQKSLSLSPGKGGGGSGGGGSGGGGSGGGGSMLPAPKNLVVSRVTEDSARLSWTAPDAAFDSFHIEYAEPWVWGEAIVLTVPGSERSYDLTGLKPGTEYVVFIGGVKGGHNSTPLSAIFTTGGGGSMLPAPKNLVVSRVTEDSARLSWTAPDAAFDSFWITYEEKFYRGEAIVLTVPGSERSYDLTGLKPGTEYKVWIVGVKGGQGSWPLSAIFTT

SEQ ID NO: 976 - protein, 662 aa, Homo sapiens
DYKDDDDKEVQLVETGGGLVKPGGSLRLSCSASRFSFRDYYMTWIRQAPGKGPEWVSHISGSGSTIYYADSVRGRFTISRDNAKSSLYLQMDSLQADDTAVYYCARGGRATSYYWVHWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPDVFLFPPKPKDTLMISRTPEVTCVVVDVSHEDPEVKFNWYVDGVEVHNAKTKPREEQYNSTYRVVSVLTVLHQDWLNGKEYKCKVSNAALPAPIAKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSMLPAPKNLVVSRVTEDSARLSWTAPDAAFDSFHIEYAEPWVWGEAIVLTVPGSERSYDLTGLKPGTEYVVFIGGVKGGHNSTPLSAIFTTGGGGSMLPAPKNLVVSRVTEDSARLSWTAPDAAFDSFWITYEEKFYRGEAIVLTVPGSERSYDLTGLKPGTEYKVWIVGVKGGQGSWPLSAIFTT

SEQ ID NO: 977 - protein, 558 aa, Homo sapiens
QITLKESGPTLVKPTQTLTLTCTFSGFSLSTSGMGVSWIRQPPGKALEWLAHIYWDDDKRYNPSLKSRLTITKDTSKNQVVLTMTNMDPVDTATYYCARLYGFTYGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPDVFLFPPKPKDTLMISRTPEVTCVVVDVSHEDPEVKFNWYVDGVEVHNAKTKPREEQYNSTYRVVSVLTVLHQDWLNGKEYKCKVSNAALPAPIAKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNRFTQKSLSLSPGKGGGGSGGGGSGGGGSGGGGSLPAPKNLVVSRVTEDSARLSWTAPDAAFDSFLIQYQESEKVGEAIVLTVPGSERSYDLTGLKPGTEYTVSIYGVKGGHRSNPLSAIFTT

SEQ ID NO: 978 - protein, 324 aa, Homo sapiens
EIVLTQSPATLSLSPGERATLSCRASQSVSGYLGWYQQKPGQAPRLLIYGASSRATGIPDRFSGSGSGTDFTLTISRLEPEDFAVYYCQQYGSSPLTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECGGGGSGGGGSGGGGSGGGGSMLPAPKNLVVSRVTEDSARLSWTAPDAAFDSFLIQYQESEKVGEAIVLTVPGSERSYDLTGLKPGTEYTVSIYGVKGGHRSNPLSAIFTT

SEQ ID NO: 979 - protein, 324 aa, Homo sapiens
EIVLTQSPATLSLSPGERATLSCRASQSVSGYLGWYQQKPGQAPRLLIYGASSRATGIPDRFSGSGSGTDFTLTISRLEPEDFAVYYCQQYGSSPLTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECGGGGSGGGGSGGGGSGGGGSMLPAPKNLVVSRVTEDSARLSWTAPDAAFDSFWITYEEKFYRGEAIVLTVPGSERSYDLTGLKPGTEYKVWIVGVKGGQGSWPLSAIFTT

SEQ ID NO: 980 - protein, 324 aa, Homo sapiens
EIVLTQSPATLSLSPGERATLSCRASQSVSGYLGWYQQKPGQAPRLLIYGASSRATGIPDRFSGSGSGTDFTLTISRLEPEDFAVYYCQQYGSSPLTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECGGGGSGGGGSGGGGSGGGGSMLPAPKNLVVSRVTEDSARLSWTAPDAAFDSFHIEYAEPWVWGEAIVLTVPGSERSYDLTGLKPGTEYVVFIGGVKGGHNSTPLSAIFTT

SEQ ID NO: 981 - protein, 328 aa, Homo sapiens
DIVMTQSPDSLAVSLGERATINCRASQSVDYNGISYMHWYQQKPGQPPKLLIYAASNPESGVPDRFSGSGSGTDFTLTISSLQAEDVAVYYCQQIIEDPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECGGGGSGGGGSGGGGSGGGGSMLPAPKNLVVSRVTEDSARLSWTAPDAAFDSFLIQYQESEKVGEAIVLTVPGSERSYDLTGLKPGTEYTVSIYGVKGGHRSNPLSAIFTT

SEQ ID NO: 982 - protein, 328 aa, Homo sapiens
DIVMTQSPDSLAVSLGERATINCRASQSVDYNGISYMHWYQQKPGQPPKLLIYAASNPESGVPDRFSGSGSGTDFTLTISSLQAEDVAVYYCQQIIEDPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECGGGGSGGGGSGGGGSGGGGSMLPAPKNLVVSRVTEDSARLSWTAPDAAFDSFWITYEEKFYRGEAIVLTVPGSERSYDLTGLKPGTEYKVWIVGVKGGQGSWPLSAIFTT

SEQ ID NO: 983 - protein, 328 aa, Homo sapiens
DIVMTQSPDSLAVSLGERATINCRASQSVDYNGISYMHWYQQKPGQPPKLLIYAASNPESGVPDRFSGSGSGTDFTLTISSLQAEDVAVYYCQQIIEDPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECGGGGSGGGGSGGGGSGGGGSMLPAPKNLVVSRVTEDSARLSWTAPDAAFDSFHIEYAEPWVWGEAIVLTVPGSERSYDLTGLKPGTEYVVFIGGVKGGHNSTPLSAIFTT

SEQ ID NO: 984 - protein, 669 aa, Homo sapiens
EVQLVETGGGLVKPGGSLRLSCSASRFSFRDYYMTWIRQAPGKGPEWVSHISGSGSTIYYADSVRGRFTISRDNAKSSLYLQMDSLQADDTAVYYCARGGRATSYYWVHWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPDVFLFPPKPKDTLMISRTPEVTCVVVDVSHEDPEVKFNWYVDGVEVHNAKTKPREEQYNSTYRVVSVLTVLHQDWLNGKEYKCKVSNAALPAPIAKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNRFTQKSLSLSPGKGGGGSGGGGSGGGGSGGGGSMLPAPKNLVVSRVTEDSARLSWTAPDAAFDSFGIGYLEYPWYGEAIVLTVPGSERSYDLTGLKPGTEYFVDIYGVKGGWWSYPLSAIFTTGGGGSGGGGSGGGGSGGGGSMLPAPKNLVVSRVTEDSARLSWTAPDAAFDSFWITYEEKFYRGEAIVLTVPGSERSYDLTGLKPGTEYKVWIVGVKGGQGSWPLSAIFTT

SEQ ID NO: 985 - protein, 669 aa, Homo sapiens
EVQLVETGGGLVKPGGSLRLSCSASRFSFRDYYMTWIRQAPGKGPEWVSHISGSGSTIYYADSVRGRFTISRDNAKSSLYLQMDSLQADDTAVYYCARGGRATSYYWVHWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPDVFLFPPKPKDTLMISRTPEVTCVVVDVSHEDPEVKFNWYVDGVEVHNAKTKPREEQYNSTYRVVSVLTVLHQDWLNGKEYKCKVSNAALPAPIAKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNRFTQKSLSLSPGKGGGGSGGGGSGGGGSGGGGSMLPAPKNLVVSRVTEDSARLSWTAPDAAFDSFNIDYFEYYEFGEAIVLTVPGSERSYDLTGLKPGTEYFVDIYGVKGGSWSLPLSAIFTTGGGGSGGGGSGGGGSGGGGSMLPAPKNLVVSRVTEDSARLSWTAPDAAFDSFWITYEEKFYRGEAIVLTVPGSERSYDLTGLKPGTEYKVWIVGVKGGQGSWPLSAIFTT

SEQ ID NO: 986 - protein, 669 aa, Homo sapiens
EVQLVETGGGLVKPGGSLRLSCSASRFSFRDYYMTWIRQAPGKGPEWVSHISGSGSTIYYADSVRGRFTISRDNAKSSLYLQMDSLQADDTAVYYCARGGRATSYYWVHWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPDVFLFPPKPKDTLMISRTPEVTCVVVDVSHEDPEVKFNWYVDGVEVHNAKTKPREEQYNSTYRVVSVLTVLHQDWLNGKEYKCKVSNAALPAPIAKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNRFTQKSLSLSPGKGGGGSGGGGSGGGGSGGGGSMLPAPKNLVVSRVTEDSARLSWTAPDAAFDSFNIHYAEYPDFGEAIVLTVPGSERSYDLTGLKPGTEYIVDIWGVKGGLGSWPLSAIFTTGGGGSGGGGSGGGGSGGGGSMLPAPKNLVVSRVTEDSARLSWTAPDAAFDSFWITYEEKFYRGEAIVLTVPGSERSYDLTGLKPGTEYKVWIVGVKGGQGSWPLSAIFTT

SEQ ID NO: 987 - protein, 669 aa, Homo sapiens
EVQLVETGGGLVKPGGSLRLSCSASRFSFRDYYMTWIRQAPGKGPEWVSHISGSGSTIYYADSVRGRFTISRDNAKSSLYLQMDSLQADDTAVYYCARGGRATSYYWVHWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPDVFLFPPKPKDTLMISRTPEVTCVVVDVSHEDPEVKFNWYVDGVEVHNAKTKPREEQYNSTYRVVSVLTVLHQDWLNGKEYKCKVSNAALPAPIAKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNRFTQKSLSLSPGKGGGGSGGGGSGGGGSGGGGSMLPAPKNLVVSRVTEDSARLSWTAPDAAFDSFHIEYAEPWVWGEAIVLTVPGSERSYDLTGLKPGTEYVVFIGGVKGGHASTPLSAIFTTGGGGSGGGGSGGGGSGGGGSMLPAPKNLVVSRVTEDSARLSWTAPDAAFDSFWITYEEKFYRGEAIVLTVPGSERSYDLTGLKPGTEYKVWIVGVKGGQGSWPLSAIFTT

SEQ ID NO: 988 - protein, 669 aa, Homo sapiens
EVQLVETGGGLVKPGGSLRLSCSASRFSFRDYYMTWIRQAPGKGPEWVSHISGSGSTIYYADSVRGRFTISRDNAKSSLYLQMDSLQADDTAVYYCARGGRATSYYWVHWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPDVFLFPPKPKDTLMISRTPEVTCVVVDVSHEDPEVKFNWYVDGVEVHNAKTKPREEQYNSTYRVVSVLTVLHQDWLNGKEYKCKVSNAALPAPIAKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNRFTQKSLSLSPGKGGGGSGGGGSGGGGSGGGGSMLPAPKNLVVSRVTEDSARLSWTAPDAAFDSFHIEYAEPWVWGEAIVLTVPGSERSYDLTGLKPGTEYVVFIGGVKGGHSSTPLSAIFTTGGGGSGGGGSGGGGSGGGGSMLPAPKNLVVSRVTEDSARLSWTAPDAAFDSFWITYEEKFYRGEAIVLTVPGSERSYDLTGLKPGTEYKVWIVGVKGGQGSWPLSAIFTT

SEQ ID NO: 989 - protein, 89 aa, Artificial
  Synthetic Luk26 Consensus Sequence
  MISC_FEATURE (32)..(32): Xaa at position 32 is any amino acid residue
  MISC_FEATURE (34)..(34): Xaa at position 32 is Glu
  MISC_FEATURE (36)..(36): Xaa at position 36 is any amino acid residue
  MISC_FEATURE (38)..(38): Xaa at position 38 is any amino acid residue
  MISC_FEATURE (39)..(39): Xaa at position 39 is Trp or a functionally equivalent amino acid residue
  MISC_FEATURE (40)..(40): Xaa at position 40 is any amino acid residue
  MISC_FEATURE (41)..(41): Xaa at position 41 is Trp
  MISC_FEATURE (42)..(42): Xaa at position 42 is any amino acid residue
  MISC_FEATURE (46)..(46): Xaa at position 46 is any amino acid residue
  MISC_FEATURE (66)..(66): Xaa at position 66 is any amino acid residue
  MISC_FEATURE (68)..(68): Xaa at position 68 is any amino acid residue
  MISC_FEATURE (70)..(70): Xaa at position 70 is Phe
  MISC_FEATURE (72)..(72): Xaa at position 72 is Gly
  MISC_FEATURE (77)..(79): Xaa at positions 77-79 is any amino acid residue
  MISC_FEATURE (81)..(82): Xaa at positions 81 and 82 is any amino acid residue
  MISC_FEATURE (84)..(84): Xaa at position 84 is any amino acid residue
  MISC_FEATURE (86)..(86): Xaa at position 86 is any amino acid residue
LPAPKNLVVSRVTEDSARLSWTAPDAAFDSFXIXYXEXXXXXEAIXLTVPGSERSYDLTGLKPGTXYXVXIXGVKGXXXSXXLXAXFTT

SEQ ID NO: 990 - protein, 89 aa, Artificial; identical to SEQ ID NO: 92
  Synthetic Luk27 Consensus Sequence
  MISC_FEATURE (32)..(32): Xaa at position 32 is any amino acid residue
  MISC_FEATURE (34)..(34): Xaa at position 34 is any amino acid residue
  MISC_FEATURE (36)..(36): Xaa at position 36 is any amino acid residue
  MISC_FEATURE (38)..(38): Xaa at position 38 is Trp
  MISC_FEATURE (39)..(41): Xaa at positions 39-41 is any amino acid residue
  MISC_FEATURE (68)..(68): Xaa at position 68 is Leu
  MISC_FEATURE (70)..(70): Xaa at position 70 is Asp
  MISC_FEATURE (72)..(72): Xaa at position 72 is Tyr
  MISC_FEATURE (78)..(78): Xaa at position 78 is any amino acid residue
  MISC_FEATURE (79)..(79): Xaa at position 79 is Trp
  MISC_FEATURE (81)..(81): Xaa at position 81 is Tyr

SEQ ID NO: 991 - protein, 96 aa, Artificial
  Synthetic Luk38 Consensus Sequence
  MISC_FEATURE (75)..(76): Xaa at positions 75 and 76 is any amino acid residue
  MISC_FEATURE (77)..(77): Xaa at position 77 is Ile
  MISC_FEATURE (78)..(79): Xaa at positions 78 and 79 is any amino acid residue
  MISC_FEATURE (80)..(80): Xaa at position 80 is Gly
  MISC_FEATURE (81)..(81): Xaa at position 81 is Trp
  MISC_FEATURE (82)..(82): Xaa at position 82 is Leu
  MISC_FEATURE (83)..(83): Xaa at position 83 is Asp
  MISC_FEATURE (84)..(84): Xaa at position 84 is Phe
  MISC_FEATURE (85)..(85): Xaa at position 85 is Val
  MISC_FEATURE (86)..(86): Xaa at position 86 is Phe
LPAPKNLVVSRVTEDSARLSWTAPDAAFDSFLIQYQESEKVGEAIVLTVPGSERSYDLTGLKPGTEYTVSIYGVXXXXXXXXXXXXSNPLSAIFTT

SEQ ID NO: 992 - protein, 89 aa, Artificial; identical to SEQ ID NO: 989
  Synthetic Luk17 Consensus
  MISC_FEATURE (32)..(32): Xaa at position 32 is Trp
  MISC_FEATURE (34)..(34): Xaa at position 34 is any amino acid residue
  MISC_FEATURE (36)..(36): Xaa at position 36 is Glu
  MISC_FEATURE (38)..(38): Xaa at position 38 is Lys
  MISC_FEATURE (39)..(39): Xaa at position 39 is Phe
  MISC_FEATURE (40)..(40): Xaa at position 40 is Tyr
  MISC_FEATURE (41)..(41): Xaa at position 41 is Arg
  MISC_FEATURE (42)..(42): Xaa at position 42 is any amino acid residue
  MISC_FEATURE (46)..(46): Xaa at position 46 is any amino acid residue
  MISC_FEATURE (66)..(66): Xaa at position 66 is any amino acid residue
  MISC_FEATURE (68)..(68): Xaa at position 68 is Lys
  MISC_FEATURE (70)..(70): Xaa at position 70 is Trp
  MISC_FEATURE (72)..(72): Xaa at position 72 is any amino acid residue
  MISC_FEATURE (77)..(79): Xaa at positions 77-79 is any amino acid residue
  MISC_FEATURE (81)..(81): Xaa at position 81 is Trp
  MISC_FEATURE (82)..(82): Xaa at position 82 is any amino acid residue
  MISC_FEATURE (84)..(84): Xaa at position 84 is any amino acid residue
  MISC_FEATURE (86)..(86): Xaa at position 86 is any amino acid residue

SEQ ID NO: 993 - protein, 15 aa, Artificial
  Synthetic Luk26 C strand/CD loop region consensus
  MISC_FEATURE (4)..(4): Xaa at position 4 is any amino acid residue
  MISC_FEATURE (6)..(6): Xaa at position 6 is Glu
  MISC_FEATURE (8)..(8): Xaa at position 8 is any amino acid residue
  MISC_FEATURE (10)..(10): Xaa at position 10 is any amino acid residue
  MISC_FEATURE (11)..(11): Xaa at position 11 is Trp
  MISC_FEATURE (12)..(12): Xaa at position 12 is any amino acid residue
  MISC_FEATURE (13)..(13): Xaa at position 13 is Trp
  MISC_FEATURE (14)..(14): Xaa at position 14 is any amino acid residue
DSFXIXYXEXXXXXE

SEQ ID NO: 994 - protein, 17 aa, Artificial
  Synthetic Luk26 F strand and FG loop region consensus
  MISC_FEATURE (2)..(2): Xaa at position 2 is any amino acid residue
  MISC_FEATURE (4)..(4): Xaa at position 4 is any amino acid residue
  MISC_FEATURE (6)..(6): Xaa at position 6 is Phe
  MISC_FEATURE (8)..(8): Xaa at position 8 is Gly
  MISC_FEATURE (13)..(15): Xaa at positions 13-15 is any amino acid residue
  MISC_FEATURE (17)..(17): Xaa at position 17 is any amino acid residue
TXYXVXIXGVKGXXXSX

SEQ ID NO: 995 - protein, 15 aa, Artificial
  Synthetic Luk27 C strand/CD loop region consensus
  MISC_FEATURE (4)..(4): Xaa at position 4 is any amino acid residue
  MISC_FEATURE (6)..(6): Xaa at position 6 is any amino acid residue
  MISC_FEATURE (8)..(8): Xaa at position 8 is any amino acid residue
  MISC_FEATURE (10)..(10): Xaa at position 10 is Trp
  MISC_FEATURE (11)..(13): Xaa at positions 11-13 is any amino acid residue
DSFXIXYXEXXXXGE

SEQ ID NO: 996 - protein, 17 aa, Artificial
  Synthetic Luk27 F strand and FG loop region consensus
  MISC_FEATURE (4)..(4): Xaa at position 4 is Leu
  MISC_FEATURE (6)..(6): Xaa at position 6 is Asp
  MISC_FEATURE (8)..(8): Xaa at position 8 is Tyr
  MISC_FEATURE (14)..(14): Xaa at position 14 is any amino acid residue
  MISC_FEATURE (15)..(15): Xaa at position 15 is Trp
  MISC_FEATURE (17)..(17): Xaa at position 17 is Tyr
TEYXVXIXGVKGGXXSX

SEQ ID NO: 997 - protein, 12 aa, Artificial
  Synthetic Luk38 FG loop region consensus
  MISC_FEATURE (1)..(2): Xaa at positions 1 and 2 is any amino acid residue
  MISC_FEATURE (3)..(3): Xaa at position 3 is Ile
  MISC_FEATURE (4)..(5): Xaa at positions 4 and 5 is any amino acid residue
  MISC_FEATURE (6)..(6): Xaa at position 6 is Gly
  MISC_FEATURE (7)..(7): Xaa at position 7 is Trp
  MISC_FEATURE (8)..(8): Xaa at position 8 is Leu
  MISC_FEATURE (9)..(9): Xaa at position 9 is Asp
  MISC_FEATURE (10)..(10): Xaa at position 10 is Phe
  MISC_FEATURE (11)..(11): Xaa at position 11 is Val
  MISC_FEATURE (12)..(12): Xaa at position 12 is Phe
XXXXXXXXXXXX

SEQ ID NO: 998 - protein, 15 aa, Artificial
  Synthetic Luk17 C strand/CD loop region consensus
  MISC_FEATURE (4)..(4): Xaa at position 4 is Trp
  MISC_FEATURE (6)..(6): Xaa at position 6 is any amino acid residue
  MISC_FEATURE (8)..(8): Xaa at position 8 is Glu
  MISC_FEATURE (10)..(10): Xaa at position 10 is Lys
  MISC_FEATURE (11)..(11): Xaa at position 11 is Phe
  MISC_FEATURE (12)..(12): Xaa at position 12 is Tyr
  MISC_FEATURE (13)..(13): Xaa at position 13 is Arg
  MISC_FEATURE (14)..(14): Xaa at position 14 is any amino acid residue
DSFXIXYXEXXXXXE

SEQ ID NO: 999 - protein, 17 aa, Artificial
  Synthetic Luk17 F strand and FG loop region consensus
  MISC_FEATURE (2)..(2): Xaa at position 2 is any amino acid residue
  MISC_FEATURE (4)..(4): Xaa at position 4 is Lys
  MISC_FEATURE (6)..(6): Xaa at position 6 is Trp
  MISC_FEATURE (8)..(8): Xaa at position 8 is any amino acid residue
  MISC_FEATURE (13)..(15): Xaa at positions 13-15 is any amino acid residue
  MISC_FEATURE (17)..(17): Xaa at positions 17 is Trp
TXYXVXIXGVKGXXXSX

SEQ ID NO: 1000 - protein, 446 aa, Homo sapiens
QVQLVQSGAEVKKPGSSVKVSCKASGGTFSSYAISWVRQAPGQGLEWMGWISAINGNTNYAQKFQGRVTITADESTSTAYMELSSLRSEDTAVYYCARIWNFLLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPDVFLFPPKPKDTLMISRTPEVTCVVVDVSHEDPEVKFNWYVDGVEVHNAKTKPREEQYNSTYRVVSVLTVLHQDWLNGKEYKCKVSNAALPAPIAKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNRFTQKSLSLSPGK

SEQ ID NO: 1001 - protein, 447 aa, Homo sapiens
QVQLVQSGAEVKKPGSSVKVSCKASGGTFSSYAISWVRQAPGQGLEWMGWISAINGNTNYAQKFQGRVTITADESTSTAYMELSSLRSEDTAVYYCARIWNFLLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1002 - protein, 446 aa, Homo sapiens
QVQLVQSGAEVKKPGSSVKVSCKASGGTFSSYAISWVRQAPGQGLEWMGWISAINGNTNYAQKFQGRVTITADESTSTAYMELSSLRSEDTAVYYCARIWNFLLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPDVFLFPPKPKDTLMISRTPEVTCVVVDVSHEDPEVKFNWYVDGVEVHNAKTKPREEQYNSTYRVVSVLTVLHQDWLNGKEYKCKVSNAALPAPIAKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1003 - protein, 453 aa, Homo sapiens; identical to SEQ ID NO: 102

SEQ ID NO: 1004 - protein, 452 aa, Homo sapiens
EVMLVESGGGLVQPKGSLKLSCAASGFTFNNYAMNWVRQAPGKGLEWVARIRSKSNNYATFYADSVKDRFTISRDDSQSMLYLQMNNLKTEDTAMYYCVRRGASGIDYAMDYWGQGTSLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPDVFLFPPKPKDTLMISRTPEVTCVVVDVSHEDPEVKFNWYVDGVEVHNAKTKPREEQYNSTYRVVSVLTVLHQDWLNGKEYKCKVSNAALPAPIAKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNRFTQKSLSLSPGK

SEQ ID NO: 1005 - protein, 452 aa, Homo sapiens
EVMLVESGGGLVQPKGSLKLSCAASGFTFNNYAMNWVRQAPGKGLEWVARIRSKSNNYATFYADSVKDRFTISRDDSQSMLYLQMNNLKTEDTAMYYCVRRGASGIDYAMDYWGQGTSLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPDVFLFPPKPKDTLMISRTPEVTCVVVDVSHEDPEVKFNWYVDGVEVHNAKTKPREEQYNSTYRVVSVLTVLHQDWLNGKEYKCKVSNAALPAPIAKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1006 - protein, 453 aa, Homo sapiens
EVMLVESGGGLVQPKGSLKLSCAASGFTFNNYAMNWVRQAPGKGLEWVARIRSKSNNYATFYADSVKDRFTISRDDSQSMLYLQMNNLKTEDTAMYYCVRRGASGIDYAMDYWGQGTSLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNRFTQKSLSLSPGK

SEQ ID NO: 1007 - protein, 451 aa, Homo sapiens
QVQLVQSGAEVKKPGSSVKVSCKASGGTFSSYAISWVRQAPGQGLEWMGGIIPIFGTANYAQKFQGRVTITADESTSTAYMELSSLRSEDTAVYYCARTELRASWGDFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1008 - protein, 450 aa, Homo sapiens
QVQLVQSGAEVKKPGSSVKVSCKASGGTFSSYAISWVRQAPGQGLEWMGGIIPIFGTANYAQKFQGRVTITADESTSTAYMELSSLRSEDTAVYYCARTELRASWGDFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPDVFLFPPKPKDTLMISRTPEVTCVVVDVSHEDPEVKFNWYVDGVEVHNAKTKPREEQYNSTYRVVSVLTVLHQDWLNGKEYKCKVSNAALPAPIAKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1009 - protein, 450 aa, Homo sapiens
QVQLVQSGAEVKKPGSSVKVSCKASGGTFSSYAISWVRQAPGQGLEWMGGIIPIFGTANYAQKFQGRVTITADESTSTAYMELSSLRSEDTAVYYCARTELRASWGDFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPDVFLFPPKPKDTLMISRTPEVTCVVVDVSHEDPEVKFNWYVDGVEVHNAKTKPREEQYNSTYRVVSVLTVLHQDWLNGKEYKCKVSNAALPAPIAKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNRFTQKSLSLSPGK

SEQ ID NO: 1010 - protein, 451 aa, Homo sapiens
QVQLVQSGAEVKKPGSSVKVSCKASGGTFSSYAISWVRQAPGQGLEWMGGIIPIFGTANYAQKFQGRVTITADESTSTAYMELSSLRSEDTAVYYCARTELRASWGDFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNRFTQKSLSLSPGK

SEQ ID NO: 1011 - protein, 447 aa, Homo sapiens
QVQLVQSGAEVKKPGSSVKVSCKASGGTFSSYAISWVRQAPGQGLEWMGWISAINGNTNYAQKFQGRVTITADESTSTAYMELSSLRSEDTAVYYCARIWNFLLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNRFTQKSLSLSPGK

SEQ ID NO: 1012 - protein, 451 aa, Homo sapiens
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARWSYSQYSGWLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1013 - protein, 451 aa, Homo sapiens
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARWSYSQYSGWLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNRFTQKSLSLSPGK

SEQ ID NO: 1014 - protein, 450 aa, Homo sapiens
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARWSYSQYSGWLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPDVFLFPPKPKDTLMISRTPEVTCVVVDVSHEDPEVKFNWYVDGVEVHNAKTKPREEQYNSTYRVVSVLTVLHQDWLNGKEYKCKVSNAALPAPIAKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1015 - protein, 450 aa, Homo sapiens
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARWSYSQYSGWLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPDVFLFPPKPKDTLMISRTPEVTCVVVDVSHEDPEVKFNWYVDGVEVHNAKTKPREEQYNSTYRVVSVLTVLHQDWLNGKEYKCKVSNAALPAPIAKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNRFTQKSLSLSPGK

SEQ ID NO: 1016 - protein, 214 aa, Homo sapiens
DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1017 - protein, 89 aa, Artificial
  Synthetic Tencon
LPAPKNLVVSEVTEDSLRLSWTAPDAAFDSFLIQYQESEKVGEAINLTVPGSERSYDLTGLKPGTEYTVSIYGVKGGHRSNPLSAEFTT

SEQ ID NO: 1018 - protein, 324 aa, Artificial
  Synthetic LukA (PDB Entry 4tw1)
NSAHKDSQDQNKKEHVDKSQQKDKRNVTNKDKNSTAPDDIGKNGKITKRTETVYDEKTNILQNLQFDFIDDPTYDKNVLLVKKQGSIHSNLKFESHKEEKNSNWLKYPSEYHVDFQVKRNRKTEILDQLPKNKISTAKVDSTFSYSSGGKFDSTKGIGRTSSNSYSKTISYNQQNYDTIASGKNNNWHVHWSVIANDLKYGGEVKNRNDELLFYRNTRIATVENPELSFASKYRYPALVRSGFNPEFLTYLSNEKSNEKTQFEVTYTRNQDILKNRPGIHYAPPILEKNKDGQRLIVTYEVDWKNKTVKVVDKYSDDNKPYKEG

SEQ ID NO: 1019 - protein, 332 aa, Artificial
  Synthetic LukA (HDX)
NSAHHHHHHGSHKDSQDQNKKEHVDKSQQKDKRNVTNKDKNSTAPDDIGKNGKITKRTETVYDEKTNILQNLQFDFIDDPTYDKNVLLVKKQGSIHSNLKFESHKEEKNSNWLKYPSEYHVDFQVKRNRKTEILDQLPKNKISTAKVDSTFSYSSGGKFDSTKGIGRTSSNSYSKTISYNQQNYDTIASGKNNNWHVHWSVIANDLKYGGEVKNRNDELLFYRNTRIATVENPELSFASKYRYPALVRSGFNPEFLTYLSNEKSNEKTQFEVTYTRNQDILKNRPGIHYAPPILEKNKDGQRLIVTYEVDWKNKTVKVVDKYSDDNKPYKAG

SEQ ID NO: 1020 - protein, 333 aa, Artificial
  Synthetic LukA (Loop Mutants)
MNSAHHHHHHGSHKDSQDQNKKEHVDKSQQKDKRNVTNKDKNSTAPDDIGKNGKITKRTETVYDEKTNILQNLQFDFIDDPTYDKNVLLVKKQGSIHSNLKFESHKEEKNSNWLKYPSEYHVDFQVKRNRKTEILDQLPKNKISTAKVDSTFSYSSGGKFDSTKGIGRTSSNSYSKTISYNQQNYDTIASGKNNNWHVHWSVIANDLKYGGEVKNRNDELLFYRNTRIATVENPELSFASKYRYPALVRSGFNPEFLTYLSNEKSNEKTQFEVTYTRNQDILKNRPGIHYAPPILEKNKDGQRLIVTYEVDWKNKTVKVVDKYSDDNKPYKAG

SEQ ID NO: 1021 - protein, 354 aa, Artificial
  Synthetic LukA (Point Mutants)
MNSAHHHHHHHHHHGGGLNDIFEAQKIEWHEGSHKDSQDQNKKEHVDKSQQKDKRNVTNKDKNSTAPDDIGKNGKITKRTETVYDEKTNILQNLQFDFIDDPTYDKNVLLVKKQGSIHSNLKFESHKEEKNSNWLKYPSEYHVDFQVKRNRKTEILDQLPKNKISTAKVDSTFSYSSGGKFDSTKGIGRTSSNSYSKTISYNQQNYDTIASGKNNNWHVHWSVIANDLKYGGEVKNRNDELLFYRNTRIATVENPELSFASKYRYPALVRSGFNPEFLTYLSNEKSNEKTQFEVTYTRNQDILKNRPGIHYAPPILEKNKDGQRLIVTYEVDWKNKTVKVVDKYSDDNKPYKAG

SEQ ID NO: 1022 - protein, 299 aa, Artificial
  Synthetic LukA mut3
MNSAHHHHHHGSHKDSQDQNKKEHVDKSQQKDKRNVTNKDKNSTAPDDIGKNGKITKRTETVYDEKTNILQNLQFDFIDDPTYDKNVLLVKKQGSIHSNLKFESHKEEKNSNWLKYPSEYHVDFQVKRNRKTEILDQLPKNKISGGSGGNYDTIASGKNNNWHVHWSVIANDLKYGGEVKNRNDELLFYRNTRIATVENPELSFASKYRYPALVRSGFNPEFLTYLSNEKSNEKTQFEVTYTRNQDILKNRPGIHYAPPILEKNKDGQRLIVTYEVDWKNKTVKVVDKYSDDNKPYKAG

SEQ ID NO: 1023 - protein, 298 aa, Artificial
  Synthetic LukA mut4
MNSAHHHHHHGSHKDSQDQNKKEHVDKSQQKDKRNVTNKDKNSTAPDDIGKNGKITKRTETVYDEKTNILQNLQFDFIDDPTYDKNVLLVKKQGSIHSNLKFESHKEEKNSNWLKYPSEYHVDFQVKRNRKTEILDQLPKNKISGGSGNYDTIASGKNNNWHVHWSVIANDLKYGGEVKNRNDELLFYRNTRIATVENPELSFASKYRYPALVRSGFNPEFLTYLSNEKSNEKTQFEVTYTRNQDILKNRPGIHYAPPILEKNKDGQRLIVTYEVDWKNKTVKVVDKYSDDNKPYKAG

SEQ ID NO: 1024 - protein, 297 aa, Artificial
  Synthetic LukA mut5
MNSAHHHHHHGSHKDSQDQNKKEHVDKSQQKDKRNVTNKDKNSTAPDDIGKNGKITKRTETVYDEKTNILQNLQFDFIDDPTYDKNVLLVKKQGSIHSNLKFESHKEEKNSNWLKYPSEYHVDFQVKRNRKTEILDQLPKNSGGSGQNYDTIASGKNNNWHVHWSVIANDLKYGGEVKNRNDELLFYRNTRIATVENPELSFASKYRYPALVRSGFNPEFLTYLSNEKSNEKTQFEVTYTRNQDILKNRPGIHYAPPILEKNKDGQRLIVTYEVDWKNKTVKVVDKYSDDNKPYKAG

SEQ ID NO: 1025 - protein, 298 aa, Artificial
  Synthetic LukA mut6
MNSAHHHHHHGSHKDSQDQNKKEHVDKSQQKDKRNVTNKDKNSTAPDDIGKNGKITKRTETVYDEKTNILQNLQFDFIDDPTYDKNVLLVKKQGSIHSNLKFESHKEEKNSNWLKYPSEYHVDFQVKRNRKTEILDQLPKNSGGSGGQNYDTIASGKNNNWHVHWSVIANDLKYGGEVKNRNDELLFYRNTRIATVENPELSFASKYRYPALVRSGFNPEFLTYLSNEKSNEKTQFEVTYTRNQDILKNRPGIHYAPPILEKNKDGQRLIVTYEVDWKNKTVKVVDKYSDDNKPYKAG

SEQ ID NO: 1026 - protein, 305 aa, Artificial
  Synthetic LukB (PDB Entry 4tw1)
KINSEIKQVSEKNLDGDTKMYTRTATTSDSQKNITQSLQFNFLTEPNYDKETVFIKAKGTIGSGLRILDPNGYWNSTLRWPGSYSVSIQNVDDNNNTNVTDFAPKNQDESREVKYTYGYKTGGDFSINRGGLTGNITKESNYSETISYQQPSYRTLLDQSTSHKGVGWKVEAHLINNMGHDHTRQLTNDSDNRTKSEIFSLTRNGNLWAKDNFTPKDKMPVTVSEGFNPEFLAVMSHDKKDKGKSQFVVHYKRSMDEFKIDWNRHGFWGYWSGENHVDKKEEKLSALYEVDWKTHNVKFVKVLND

SEQ ID NO: 1027 - protein, 309 aa, Artificial; identical to SEQ ID NO: 11
  Synthetic LukB (HDX)

SEQ ID NO: 1028 - protein, 310 aa, Artificial
  Synthetic LukB (Mutants)
MKINSEIKQVSEKNLDGDTKMYTRTATTSDSQKNITQSLQFNFLTEPNYDKETVFIKAKGTIGSGLRILDPNGYWNSTLRWPGSYSVSIQNVDDNNNTNVTDFAPKNQDESREVKYTYGYKTGGDFSINRGGLTGNITKESNYSETISYQQPSYRTLLDQSTSHKGVGWKVEAHLINNMGHDHTRQLTNDSDNRTKSEIFSLTRNGNLWAKDNFTPKDKMPVTVSEGFNPEFLAVMSHDKKDKGKSQFVVHYKRSMDEFKIDWNRHGFWGYWSGENHVDKKEEKLSALYEVDWKTHNVKFVKVLNDNEKK

SEQ ID NO: 1029 - protein, 274 aa, Artificial
  Synthetic LukB mut3
MKINSEIKQVSEKNLDGDTKMYTRTATTSDSQKNITQSLQFNFLTEPNYDKETVFIKAKGTIGSGLRILDPNGYWNSTLRWPGSYSVSIQNVDDNNNTNVTDFAPKNQDESGGSGGSYRTLLDQSTSHKGVGWKVEAHLINNMGHDHTRQLTNDSDNRTKSEIFSLTRNGNLWAKDNFTPKDKMPVTVSEGFNPEFLAVMSHDKKDKGKSQFVVHYKRSMDEFKIDWNRHGFWGYWSGENHVDKKEEKLSALYEVDWKTHNVKFVKVLNDNEKK

SEQ ID NO: 1030 - protein, 273 aa, Artificial
  Synthetic LukB mut4
MKINSEIKQVSEKNLDGDTKMYTRTATTSDSQKNITQSLQFNFLTEPNYDKETVFIKAKGTIGSGLRILDPNGYWNSTLRWPGSYSVSIQNVDDNNNTNVTDFAPKNQDESGGSGSYRTLLDQSTSHKGVGWKVEAHLINNMGHDHTRQLTNDSDNRTKSEIFSLTRNGNLWAKDNFTPKDKMPVTVSEGFNPEFLAVMSHDKKDKGKSQFVVHYKRSMDEFKIDWNRHGFWGYWSGENHVDKKEEKLSALYEVDWKTHNVKFVKVLNDNEKK

SEQ ID NO: 1031 - protein, 274 aa, Artificial
  Synthetic LukB mut5
MKINSEIKQVSEKNLDGDTKMYTRTATTSDSQKNITQSLQFNFLTEPNYDKETVFIKAKGTIGSGLRILDPNGYWNSTLRWPGSYSVSIQNVDDNNNTNVTDFAPKNQDESGGSGPSYRTLLDQSTSHKGVGWKVEAHLINNMGHDHTRQLTNDSDNRTKSEIFSLTRNGNLWAKDNFTPKDKMPVTVSEGFNPEFLAVMSHDKKDKGKSQFVVHYKRSMDEFKIDWNRHGFWGYWSGENHVDKKEEKLSALYEVDWKTHNVKFVKVLNDNEKK

SEQ ID NO: 1032 - protein, 272 aa, Artificial
  Synthetic LukB mut6
MKINSEIKQVSEKNLDGDTKMYTRTATTSDSQKNITQSLQFNFLTEPNYDKETVFIKAKGTIGSGLRILDPNGYWNSTLRWPGSYSVSIQNVDDNNNTNVTDFAPKNQSGGSGPSYRTLLDQSTSHKGVGWKVEAHLINNMGHDHTRQLTNDSDNRTKSEIFSLTRNGNLWAKDNFTPKDKMPVTVSEGFNPEFLAVMSHDKKDKGKSQFVVHYKRSMDEFKIDWNRHGFWGYWSGENHVDKKEEKLSALYEVDWKTHNVKFVKVLNDNEKK

SEQ ID NO: 1033 - protein, 310 aa, Artificial
  Synthetic LukB_Y74A
MKINSEIKQVSEKNLDGDTKMYTRTATTSDSQKNITQSLQFNFLTEPNYDKETVFIKAKGTIGSGLRILDPNGAWNSTLRWPGSYSVSIQNVDDNNNTNVTDFAPKNQDESREVKYTYGYKTGGDFSINRGGLTGNITKESNYSETISYQQPSYRTLLDQSTSHKGVGWKVEAHLINNMGHDHTRQLTNDSDNRTKSEIFSLTRNGNLWAKDNFTPKDKMPVTVSEGFNPEFLAVMSHDKKDKGKSQFVVHYKRSMDEFKIDWNRHGFWGYWSGENHVDKKEEKLSALYEVDWKTHNVKFVKVLNDNEKK

SEQ ID NO: 1034 - protein, 310 aa, Artificial
  Synthetic LukB_W75A
MKINSEIKQVSEKNLDGDTKMYTRTATTSDSQKNITQSLQFNFLTEPNYDKETVFIKAKGTIGSGLRILDPNGYANSTLRWPGSYSVSIQNVDDNNNTNVTDFAPKNQDESREVKYTYGYKTGGDFSINRGGLTGNITKESNYSETISYQQPSYRTLLDQSTSHKGVGWKVEAHLINNMGHDHTRQLTNDSDNRTKSEIFSLTRNGNLWAKDNFTPKDKMPVTVSEGFNPEFLAVMSHDKKDKGKSQFVVHYKRSMDEFKIDWNRHGFWGYWSGENHVDKKEEKLSALYEVDWKTHNVKFVKVLNDNEKK

SEQ ID NO: 1035 - protein, 310 aa, Artificial
  Synthetic LukB_R194A
MKINSEIKQVSEKNLDGDTKMYTRTATTSDSQKNITQSLQFNFLTEPNYDKETVFIKAKGTIGSGLRILDPNGYWNSTLRWPGSYSVSIQNVDDNNNTNVTDFAPKNQDESREVKYTYGYKTGGDFSINRGGLTGNITKESNYSETISYQQPSYRTLLDQSTSHKGVGWKVEAHLINNMGHDHTRQLTNDSDNATKSEIFSLTRNGNLWAKDNFTPKDKMPVTVSEGFNPEFLAVMSHDKKDKGKSQFVVHYKRSMDEFKIDWNRHGFWGYWSGENHVDKKEEKLSALYEVDWKTHNVKFVKVLNDNEKK

SEQ ID NO: 1036 - protein, 310 aa, Artificial
  Synthetic LukB_K196A
MKINSEIKQVSEKNLDGDTKMYTRTATTSDSQKNITQSLQFNFLTEPNYDKETVFIKAKGTIGSGLRILDPNGYWNSTLRWPGSYSVSIQNVDDNNNTNVTDFAPKNQDESREVKYTYGYKTGGDFSINRGGLTGNITKESNYSETISYQQPSYRTLLDQSTSHKGVGWKVEAHLINNMGHDHTRQLTNDSDNRTASEIFSLTRNGNLWAKDNFTPKDKMPVTVSEGFNPEFLAVMSHDKKDKGKSQFVVHYKRSMDEFKIDWNRHGFWGYWSGENHVDKKEEKLSALYEVDWKTHNVKFVKVLNDNEKK

SEQ ID NO: 1037 - protein, 310 aa, Artificial
  Synthetic LukB_R204A
MKINSEIKQVSEKNLDGDTKMYTRTATTSDSQKNITQSLQFNFLTEPNYDKETVFIKAKGTIGSGLRILDPNGYWNSTLRWPGSYSVSIQNVDDNNNTNVTDFAPKNQDESREVKYTYGYKTGGDFSINRGGLTGNITKESNYSETISYQQPSYRTLLDQSTSHKGVGWKVEAHLINNMGHDHTRQLTNDSDNRTKSEIFSLTANGNLWAKDNFTPKDKMPVTVSEGFNPEFLAVMSHDKKDKGKSQFVVHYKRSMDEFKIDWNRHGFWGYWSGENHVDKKEEKLSALYEVDWKTHNVKFVKVLNDNEKK

SEQ ID NO: 1038 - protein, 310 aa, Artificial
  Synthetic LukB_N205A
MKINSEIKQVSEKNLDGDTKMYTRTATTSDSQKNITQSLQFNFLTEPNYDKETVFIKAKGTIGSGLRILDPNGYWNSTLRWPGSYSVSIQNVDDNNNTNVTDFAPKNQDESREVKYTYGYKTGGDFSINRGGLTGNITKESNYSETISYQQPSYRTLLDQSTSHKGVGWKVEAHLINNMGHDHTRQLTNDSDNRTKSEIFSLTRAGNLWAKDNFTPKDKMPVTVSEGFNPEFLAVMSHDKKDKGKSQFVVHYKRSMDEFKIDWNRHGFWGYWSGENHVDKKEEKLSALYEVDWKTHNVKFVKVLNDNEKK

SEQ ID NO: 1039 - protein, 310 aa, Artificial
  Synthetic LukB_N207A
MKINSEIKQVSEKNLDGDTKMYTRTATTSDSQKNITQSLQFNFLTEPNYDKETVFIKAKGTIGSGLRILDPNGYWNSTLRWPGSYSVSIQNVDDNNNTNVTDFAPKNQDESREVKYTYGYKTGGDFSINRGGLTGNITKESNYSETISYQQPSYRTLLDQSTSHKGVGWKVEAHLINNMGHDHTRQLTNDSDNRTKSEIFSLTRNGALWAKDNFTPKDKMPVTVSEGFNPEFLAVMSHDKKDKGKSQFVVHYKRSMDEFKIDWNRHGFWGYWSGENHVDKKEEKLSALYEVDWKTHNVKFVKVLNDNEKK

SEQ ID NO: 1040 - protein, 310 aa, Artificial
  Synthetic LukB_W209A
MKINSEIKQVSEKNLDGDTKMYTRTATTSDSQKNITQSLQFNFLTEPNYDKETVFIKAKGTIGSGLRILDPNGYWNSTLRWPGSYSVSIQNVDDNNNTNVTDFAPKNQDESREVKYTYGYKTGGDFSINRGGLTGNITKESNYSETISYQQPSYRTLLDQSTSHKGVGWKVEAHLINNMGHDHTRQLTNDSDNRTKSEIFSLTRNGNLAAKDNFTPKDKMPVTVSEGFNPEFLAVMSHDKKDKGKSQFVVHYKRSMDEFKIDWNRHGFWGYWSGENHVDKKEEKLSALYEVDWKTHNVKFVKVLNDNEKK

SEQ ID NO: 1041 - protein, 310 aa, Artificial
  Synthetic LukB_D262A
MKINSEIKQVSEKNLDGDTKMYTRTATTSDSQKNITQSLQFNFLTEPNYDKETVFIKAKGTIGSGLRILDPNGYWNSTLRWPGSYSVSIQNVDDNNNTNVTDFAPKNQDESREVKYTYGYKTGGDFSINRGGLTGNITKESNYSETISYQQPSYRTLLDQSTSHKGVGWKVEAHLINNMGHDHTRQLTNDSDNRTKSEIFSLTRNGNLWAKDNFTPKDKMPVTVSEGFNPEFLAVMSHDKKDKGKSQFVVHYKRSMDEFKIAWNRHGFWGYWSGENHVDKKEEKLSALYEVDWKTHNVKFVKVLNDNEKK

SEQ ID NO: 1042 - protein, 310 aa, Artificial
  Synthetic LukB_D262R
MKINSEIKQVSEKNLDGDTKMYTRTATTSDSQKNITQSLQFNFLTEPNYDKETVFIKAKGTIGSGLRILDPNGYWNSTLRWPGSYSVSIQNVDDNNNTNVTDFAPKNQDESREVKYTYGYKTGGDFSINRGGLTGNITKESNYSETISYQQPSYRTLLDQSTSHKGVGWKVEAHLINNMGHDHTRQLTNDSDNRTKSEIFSLTRNGNLWAKDNFTPKDKMPVTVSEGFNPEFLAVMSHDKKDKGKSQFVVHYKRSMDEFKIRWNRHGFWGYWSGENHVDKKEEKLSALYEVDWKTHNVKFVKVLNDNEKK

SEQ ID NO: 1043 - protein, 310 aa, Artificial
  Synthetic LukB_W263A
MKINSEIKQVSEKNLDGDTKMYTRTATTSDSQKNITQSLQFNFLTEPNYDKETVFIKAKGTIGSGLRILDPNGYWNSTLRWPGSYSVSIQNVDDNNNTNVTDFAPKNQDESREVKYTYGYKTGGDFSINRGGLTGNITKESNYSETISYQQPSYRTLLDQSTSHKGVGWKVEAHLINNMGHDHTRQLTNDSDNRTKSEIFSLTRNGNLWAKDNFTPKDKMPVTVSEGFNPEFLAVMSHDKKDKGKSQFVVHYKRSMDEFKIDANRHGFWGYWSGENHVDKKEEKLSALYEVDWKTHNVKFVKVLNDNEKK

SEQ ID NO: 1044 - protein, 310 aa, Artificial
  Synthetic LukB_N264A
MKINSEIKQVSEKNLDGDTKMYTRTATTSDSQKNITQSLQFNFLTEPNYDKETVFIKAKGTIGSGLRILDPNGYWNSTLRWPGSYSVSIQNVDDNNNTNVTDFAPKNQDESREVKYTYGYKTGGDFSINRGGLTGNITKESNYSETISYQQPSYRTLLDQSTSHKGVGWKVEAHLINNMGHDHTRQLTNDSDNRTKSEIFSLTRNGNLWAKDNFTPKDKMPVTVSEGFNPEFLAVMSHDKKDKGKSQFVVHYKRSMDEFKIDWARHGFWGYWSGENHVDKKEEKLSALYEVDWKTHNVKFVKVLNDNEKK

SEQ ID NO: 1045 - protein, 310 aa, Artificial
  Synthetic LukB_R265A
MKINSEIKQVSEKNLDGDTKMYTRTATTSDSQKNITQSLQFNFLTEPNYDKETVFIKAKGTIGSGLRILDPNGYWNSTLRWPGSYSVSIQNVDDNNNTNVTDFAPKNQDESREVKYTYGYKTGGDFSINRGGLTGNITKESNYSETISYQQPSYRTLLDQSTSHKGVGWKVEAHLINNMGHDHTRQLTNDSDNRTKSEIFSLTRNGNLWAKDNFTPKDKMPVTVSEGFNPEFLAVMSHDKKDKGKSQFVVHYKRSMDEFKIDWNAHGFWGYWSGENHVDKKEEKLSALYEVDWKTHNVKFVKVLNDNEKK

SEQ ID NO: 1046 - protein, 310 aa, Artificial
  Synthetic LukB_R265E
MKINSEIKQVSEKNLDGDTKMYTRTATTSDSQKNITQSLQFNFLTEPNYDKETVFIKAKGTIGSGLRILDPNGYWNSTLRWPGSYSVSIQNVDDNNNTNVTDFAPKNQDESREVKYTYGYKTGGDFSINRGGLTGNITKESNYSETISYQQPSYRTLLDQSTSHKGVGWKVEAHLINNMGHDHTRQLTNDSDNRTKSEIFSLTRNGNLWAKDNFTPKDKMPVTVSEGFNPEFLAVMSHDKKDKGKSQFVVHYKRSMDEFKIDWNEHGFWGYWSGENHVDKKEEKLSALYEVDWKTHNVKFVKVLNDNEKK

SEQ ID NO: 1047 - protein, 310 aa, Artificial
  Synthetic LukB_H266A
MKINSEIKQVSEKNLDGDTKMYTRTATTSDSQKNITQSLQFNFLTEPNYDKETVFIKAKGTIGSGLRILDPNGYWNSTLRWPGSYSVSIQNVDDNNNTNVTDFAPKNQDESREVKYTYGYKTGGDFSINRGGLTGNITKESNYSETISYQQPSYRTLLDQSTSHKGVGWKVEAHLINNMGHDHTRQLTNDSDNRTKSEIFSLTRNGNLWAKDNFTPKDKMPVTVSEGFNPEFLAVMSHDKKDKGKSQFVVHYKRSMDEFKIDWNRAGFWGYWSGENHVDKKEEKLSALYEVDWKTHNVKFVKVLNDNEKK

SEQ ID NO: 1048 - protein, 310 aa, Artificial
  Synthetic LukB_G267R
MKINSEIKQVSEKNLDGDTKMYTRTATTSDSQKNITQSLQFNFLTEPNYDKETVFIKAKGTIGSGLRILDPNGYWNSTLRWPGSYSVSIQNVDDNNNTNVTDFAPKNQDESREVKYTYGYKTGGDFSINRGGLTGNITKESNYSETISYQQPSYRTLLDQSTSHKGVGWKVEAHLINNMGHDHTRQLTNDSDNRTKSEIFSLTRNGNLWAKDNFTPKDKMPVTVSEGFNPEFLAVMSHDKKDKGKSQFVVHYKRSMDEFKIDWNRHRFWGYWSGENHVDKKEEKLSALYEVDWKTHNVKFVKVLNDNEKK

SEQ ID NO: 1049 - protein, 310 aa, Artificial
  Synthetic LukB_G267A
MKINSEIKQVSEKNLDGDTKMYTRTATTSDSQKNITQSLQFNFLTEPNYDKETVFIKAKGTIGSGLRILDPNGYWNSTLRWPGSYSVSIQNVDDNNNTNVTDFAPKNQDESREVKYTYGYKTGGDFSINRGGLTGNITKESNYSETISYQQPSYRTLLDQSTSHKGVGWKVEAHLINNMGHDHTRQLTNDSDNRTKSEIFSLTRNGNLWAKDNFTPKDKMPVTVSEGFNPEFLAVMSHDKKDKGKSQFVVHYKRSMDEFKIDWNRHAFWGYWSGENHVDKKEEKLSALYEVDWKTHNVKFVKVLNDNEKK

SEQ ID NO: 1050 - protein, 310 aa, Artificial
  Synthetic LukB_F268A
MKINSEIKQVSEKNLDGDTKMYTRTATTSDSQKNITQSLQFNFLTEPNYDKETVFIKAKGTIGSGLRILDPNGYWNSTLRWPGSYSVSIQNVDDNNNTNVTDFAPKNQDESREVKYTYGYKTGGDFSINRGGLTGNITKESNYSETISYQQPSYRTLLDQSTSHKGVGWKVEAHLINNMGHDHTRQLTNDSDNRTKSEIFSLTRNGNLWAKDNFTPKDKMPVTVSEGFNPEFLAVMSHDKKDKGKSQFVVHYKRSMDEFKIDWNRHGAWGYWSGENHVDKKEEKLSALYEVDWKTHNVKFVKVLNDNEKK

SEQ ID NO: 1051 - protein, 310 aa, Artificial
  Synthetic LukB_W269A
MKINSEIKQVSEKNLDGDTKMYTRTATTSDSQKNITQSLQFNFLTEPNYDKETVFIKAKGTIGSGLRILDPNGYWNSTLRWPGSYSVSIQNVDDNNNTNVTDFAPKNQDESREVKYTYGYKTGGDFSINRGGLTGNITKESNYSETISYQQPSYRTLLDQSTSHKGVGWKVEAHLINNMGHDHTRQLTNDSDNRTKSEIFSLTRNGNLWAKDNFTPKDKMPVTVSEGFNPEFLAVMSHDKKDKGKSQFVVHYKRSMDEFKIDWNRHGFAGYWSGENHVDKKEEKLSALYEVDWKTHNVKFVKVLNDNEKK

SEQ ID NO: 1052 - protein, 310 aa, Artificial
  Synthetic LukB_Y271A
MKINSEIKQVSEKNLDGDTKMYTRTATTSDSQKNITQSLQFNFLTEPNYDKETVFIKAKGTIGSGLRILDPNGYWNSTLRWPGSYSVSIQNVDDNNNTNVTDFAPKNQDESREVKYTYGYKTGGDFSINRGGLTGNITKESNYSETISYQQPSYRTLLDQSTSHKGVGWKVEAHLINNMGHDHTRQLTNDSDNRTKSEIFSLTRNGNLWAKDNFTPKDKMPVTVSEGFNPEFLAVMSHDKKDKGKSQFVVHYKRSMDEFKIDWNRHGFWGAWSGENHVDKKEEKLSALYEVDWKTHNVKFVKVLNDNEKK

SEQ ID NO: 1053 - protein, 98 aa, Artificial
  Synthetic Luk17
MLPAPKNLVVSRVTEDSARLSWTAPDAAFDSFWITYEEKFYRGEAIVLTVPGSERSYDLTGLKPGTEYKVWIVGVKGGQGSWPLSAIFTTGGHHHHHH

SEQ ID NO: 1054 - protein, 311 aa, Artificial
  Synthetic LukE (PDB Entry 3rohA)
MFKKKMLAATLSVGLIAPLASPIQESRANTNIENIGDGAEVIKRTEDVSSKKWGVTQNVQFDFVKDKKYNKDALIVKMQGFINSRTSFSDVKGSGYELTKRMIWPFQYNIGLTTKDPNVSLINYLPKNKIETTDVGQTLGYNIGGNFQSAPSIGGNGSFNYSKTISYTQKSYVSEVDKQNSKSVKWGVKANEFVTPDGKKSAHDRYLFVQSPNGPTGSAREYFAPDNQLPPLVQSGFNPSFITTLSHEKGSSDTSEFEISYGRNLDITYATLFPRTGIYAERKHNAFVNRNFVVRYEVNWKTHEIKVKGHN

SEQ ID NO: 1055 - protein, 294 aa, Artificial
  Synthetic LukE (HDX)
NSAHHHHHHGSNTNIENIGDGAEVIKRTEDVSSKKWGVTQNVQFDFVKDKKYNKDALIVKMQGFINSRTSFSDVKGSGYELTKRMIWPFQYNIGLTTKDPNVSLINYLPKNKIETTDVGQTLGYNIGGNFQSAPSIGGNGSFNYSKTISYTQKSYVSEVDKQNSKSVKWGVKANEFVTPDGKKSAHDRYLFVQSPNGPTGSAREYFAPDNQLPPLVQSGFNPSFITTLSHEKGSSDTSEFELSYGRNLDITYATLFPRTGIYAERKHNAFVNRNFVVRYKVNWKTHEIKVKGHN

SEQ ID NO: 1056 - protein, 327 aa, Artificial
  Synthetic LukE (Mutants)
MGSSGLNDIFEAQKIEWHEGGHHHHHHHHHHSSGLVPRGSHMLENTNIENIGDGAEVIKRTEDVSSKKWGVTQNVQFDFVKDKKYNKDALIVKMQGFINSRTSFSDVKGSGYELTKRMIWPFQYNIGLTTKDPNVSLINYLPKNKIETTDVGQTLGYNIGGNFQSAPSIGGNGSFNYSKTISYTQKSYVSEVDKQNSKSVKWGVKANEFVTPDGKKSAHDRYLFVQSPNGPTGSAREYFAPDNQLPPLVQSGFNPSFITTLSHEKGSSDTSEFEISYGRNLDITYATLFPRTGIYAERKHNAFVNRNFVVRYEVNWKTHEIKVKGHN

SEQ ID NO: 1057 - protein, 327 aa, Artificial
  Synthetic LukE_S105A
MGSSGLNDIFEAQKIEWHEGGHHHHHHHHHHSSGLVPRGSHMLENTNIENIGDGAEVIKRTEDVSSKKWGVTQNVQFDFVKDKKYNKDALIVKMQGFINSRTSFADVKGSGYELTKRMIWPFQYNIGLTTKDPNVSLINYLPKNKIETTDVGQTLGYNIGGNFQSAPSIGGNGSFNYSKTISYTQKSYVSEVDKQNSKSVKWGVKANEFVTPDGKKSAHDRYLFVQSPNGPTGSAREYFAPDNQLPPLVQSGFNPSFITTLSHEKGSSDTSEFEISYGRNLDITYATLFPRTGIYAERKHNAFVNRNFVVRYEVNWKTHEIKVKGHN

SEQ ID NO: 1058 - protein, 327 aa, Artificial
  Synthetic LukE_V107A
MGSSGLNDIFEAQKIEWHEGGHHHHHHHHHHSSGLVPRGSHMLENTNIENIGDGAEVIKRTEDVSSKKWGVTQNVQFDFVKDKKYNKDALIVKMQGFINSRTSFSDAKGSGYELTKRMIWPFQYNIGLTTKDPNVSLINYLPKNKIETTDVGQTLGYNIGGNFQSAPSIGGNGSFNYSKTISYTQKSYVSEVDKQNSKSVKWGVKANEFVTPDGKKSAHDRYLFVQSPNGPTGSAREYFAPDNQLPPLVQSGFNPSFITTLSHEKGSSDTSEFEISYGRNLDITYATLFPRTGIYAERKHNAFVNRNFVVRYEVNWKTHEIKVKGHN

SEQ ID NO: 1059 - protein, 327 aa, Artificial
  Synthetic LukE_K108A
MGSSGLNDIFEAQKIEWHEGGHHHHHHHHHHSSGLVPRGSHMLENTNIENIGDGAEVIKRTEDVSSKKWGVTQNVQFDFVKDKKYNKDALIVKMQGFINSRTSFSDVAGSGYELTKRMIWPFQYNIGLTTKDPNVSLINYLPKNKIETTDVGQTLGYNIGGNFQSAPSIGGNGSFNYSKTISYTQKSYVSEVDKQNSKSVKWGVKANEFVTPDGKKSAHDRYLFVQSPNGPTGSAREYFAPDNQLPPLVQSGFNPSFITTLSHEKGSSDTSEFEISYGRNLDITYATLFPRTGIYAERKHNAFVNRNFVVRYEVNWKTHEIKVKGHN

SEQ ID NO: 1060 - protein, 327 aa, Artificial
  Synthetic LukE_G109R
MGSSGLNDIFEAQKIEWHEGGHHHHHHHHHHSSGLVPRGSHMLENTNIENIGDGAEVIKRTEDVSSKKWGVTQNVQFDFVKDKKYNKDALIVKMQGFINSRTSFSDVKRSGYELTKRMIWPFQYNIGLTTKDPNVSLINYLPKNKIETTDVGQTLGYNIGGNFQSAPSIGGNGSFNYSKTISYTQKSYVSEVDKQNSKSVKWGVKANEFVTPDGKKSAHDRYLFVQSPNGPTGSAREYFAPDNQLPPLVQSGFNPSFITTLSHEKGSSDTSEFEISYGRNLDITYATLFPRTGIYAERKHNAFVNRNFVVRYEVNWKTHEIKVKGHN

SEQ ID NO: 1061 - protein, 327 aa, Artificial
  Synthetic LukE_Y112A
MGSSGLNDIFEAQKIEWHEGGHHHHHHHHHHSSGLVPRGSHMLENTNIENIGDGAEVIKRTEDVSSKKWGVTQNVQFDFVKDKKYNKDALIVKMQGFINSRTSFSDVKGSGAELTKRMIWPFQYNIGLTTKDPNVSLINYLPKNKIETTDVGQTLGYNIGGNFQSAPSIGGNGSFNYSKTISYTQKSYVSEVDKQNSKSVKWGVKANEFVTPDGKKSAHDRYLFVQSPNGPTGSAREYFAPDNQLPPLVQSGFNPSFITTLSHEKGSSDTSEFEISYGRNLDITYATLFPRTGIYAERKHNAFVNRNFVVRYEVNWKTHEIKVKGHN

SEQ ID NO: 1062 - protein, 327 aa, Artificial
  Synthetic LukE_L114A
MGSSGLNDIFEAQKIEWHEGGHHHHHHHHHHSSGLVPRGSHMLENTNIENIGDGAEVIKRTEDVSSKKWGVTQNVQFDFVKDKKYNKDALIVKMQGFINSRTSFSDVKGSGYEATKRMIWPFQYNIGLTTKDPNVSLINYLPKNKIETTDVGQTLGYNIGGNFQSAPSIGGNGSFNYSKTISYTQKSYVSEVDKQNSKSVKWGVKANEFVTPDGKKSAHDRYLFVQSPNGPTGSAREYFAPDNQLPPLVQSGFNPSFITTLSHEKGSSDTSEFEISYGRNLDITYATLFPRTGIYAERKHNAFVNRNFVVRYEVNWKTHEIKVKGHN

SEQ ID NO: 1063 - protein, 327 aa, Artificial
  Synthetic LukE_T115A
MGSSGLNDIFEAQKIEWHEGGHHHHHHHHHHSSGLVPRGSHMLENTNIENIGDGAEVIKRTEDVSSKKWGVTQNVQFDFVKDKKYNKDALIVKMQGFINSRTSFSDVKGSGYELAKRMIWPFQYNIGLTTKDPNVSLINYLPKNKIETTDVGQTLGYNIGGNFQSAPSIGGNGSFNYSKTISYTQKSYVSEVDKQNSKSVKWGVKANEFVTPDGKKSAHDRYLFVQSPNGPTGSAREYFAPDNQLPPLVQSGFNPSFITTLSHEKGSSDTSEFEISYGRNLDITYATLFPRTGIYAERKHNAFVNRNFVVRYEVNWKTHEIKVKGHN

SEQ ID NO: 1064 - protein, 327 aa, Artificial
  Synthetic LukE_R117A
MGSSGLNDIFEAQKIEWHEGGHHHHHHHHHHSSGLVPRGSHMLENTNIENIGDGAEVIKRTEDVSSKKWGVTQNVQFDFVKDKKYNKDALIVKMQGFINSRTSFSDVKGSGYELTKAMIWPFQYNIGLTTKDPNVSLINYLPKNKIETTDVGQTLGYNIGGNFQSAPSIGGNGSFNYSKTISYTQKSYVSEVDKQNSKSVKWGVKANEFVTPDGKKSAHDRYLFVQSPNGPTGSAREYFAPDNQLPPLVQSGFNPSFITTLSHEKGSSDTSEFEISYGRNLDITYATLFPRTGIYAERKHNAFVNRNFVVRYEVNWKTHEIKVKGHN

SEQ ID NO: 1065 - protein, 327 aa, Artificial
  Synthetic LukE_I283A
MGSSGLNDIFEAQKIEWHEGGHHHHHHHHHHSSGLVPRGSHMLENTNIENIGDGAEVIKRTEDVSSKKWGVTQNVQFDFVKDKKYNKDALIVKMQGFINSRTSFSDVKGSGYELTKRMIWPFQYNIGLTTKDPNVSLINYLPKNKIETTDVGQTLGYNIGGNFQSAPSIGGNGSFNYSKTISYTQKSYVSEVDKQNSKSVKWGVKANEFVTPDGKKSAHDRYLFVQSPNGPTGSAREYFAPDNQLPPLVQSGFNPSFITTLSHEKGSSDTSEFEISYGRNLDATYATLFPRTGIYAERKHNAFVNRNFVVRYEVNWKTHEIKVKGHN

SEQ ID NO: 1066 - protein, 327 aa, Artificial
  Synthetic LukE_Y285A
MGSSGLNDIFEAQKIEWHEGGHHHHHHHHHHSSGLVPRGSHMLENTNIENIGDGAEVIKRTEDVSSKKWGVTQNVQFDFVKDKKYNKDALIVKMQGFINSRTSFSDVKGSGYELTKRMIWPFQYNIGLTTKDPNVSLINYLPKNKIETTDVGQTLGYNIGGNFQSAPSIGGNGSFNYSKTISYTQKSYVSEVDKQNSKSVKWGVKANEFVTPDGKKSAHDRYLFVQSPNGPTGSAREYFAPDNQLPPLVQSGFNPSFITTLSHEKGSSDTSEFEISYGRNLDITAATLFPRTGIYAERKHNAFVNRNFVVRYEVNWKTHEIKVKGHN

SEQ ID NO: 1067 - protein, 327 aa, Artificial
  Synthetic LukE_T287A
MGSSGLNDIFEAQKIEWHEGGHHHHHHHHHHSSGLVPRGSHMLENTNIENIGDGAEVIKRTEDVSSKKWGVTQNVQFDFVKDKKYNKDALIVKMQGFINSRTSFSDVKGSGYELTKRMIWPFQYNIGLTTKDPNVSLINYLPKNKIETTDVGQTLGYNIGGNFQSAPSIGGNGSFNYSKTISYTQKSYVSEVDKQNSKSVKWGVKANEFVTPDGKKSAHDRYLFVQSPNGPTGSAREYFAPDNQLPPLVQSGFNPSFITTLSHEKGSSDTSEFEISYGRNLDITYAALFPRTGIYAERKHNAFVNRNFVVRYEVNWKTHEIKVKGHN

SEQ ID NO: 1068 - protein, 327 aa, Artificial
  Synthetic LukE_F289A
MGSSGLNDIFEAQKIEWHEGGHHHHHHHHHHSSGLVPRGSHMLENTNIENIGDGAEVIKRTEDVSSKKWGVTQNVQFDFVKDKKYNKDALIVKMQGFINSRTSFSDVKGSGYELTKRMIWPFQYNIGLTTKDPNVSLINYLPKNKIETTDVGQTLGYNIGGNFQSAPSIGGNGSFNYSKTISYTQKSYVSEVDKQNSKSVKWGVKANEFVTPDGKKSAHDRYLFVQSPNGPTGSAREYFAPDNQLPPLVQSGFNPSFITTLSHEKGSSDTSEFEISYGRNLDITYATLAPRTGIYAERKHNAFVNRNFVVRYEVNWKTHEIKVKGHN

SEQ ID NO: 1069 - protein, 327 aa, Artificial
  Synthetic LukE_T292A
MGSSGLNDIFEAQKIEWHEGGHHHHHHHHHHSSGLVPRGSHMLENTNIENIGDGAEVIKRTEDVSSKKWGVTQNVQFDFVKDKKYNKDALIVKMQGFINSRTSFSDVKGSGYELTKRMIWPFQYNIGLTTKDPNVSLINYLPKNKIETTDVGQTLGYNIGGNFQSAPSIGGNGSFNYSKTISYTQKSYVSEVDKQNSKSVKWGVKANEFVTPDGKKSAHDRYLFVQSPNGPTGSAREYFAPDNQLPPLVQSGFNPSFITTLSHEKGSSDTSEFEISYGRNLDITYATLFPRAGIYAERKHNAFVNRNFVVRYEVNWKTHEIKVKGHN

SEQ ID NO: 1070 - protein, 327 aa, Artificial
  Synthetic LukE_Y295A
MGSSGLNDIFEAQKIEWHEGGHHHHHHHHHHSSGLVPRGSHMLENTNIENIGDGAEVIKRTEDVSSKKWGVTQNVQFDFVKDKKYNKDALIVKMQGFINSRTSFSDVKGSGYELTKRMIWPFQYNIGLTTKDPNVSLINYLPKNKIETTDVGQTLGYNIGGNFQSAPSIGGNGSFNYSKTISYTQKSYVSEVDKQNSKSVKWGVKANEFVTPDGKKSAHDRYLFVQSPNGPTGSAREYFAPDNQLPPLVQSGFNPSFITTLSHEKGSSDTSEFEISYGRNLDITYATLFPRTGIAAERKHNAFVNRNFVVRYEVNWKTHEIKVKGHN

SEQ ID NO: 1071 - protein, 327 aa, Artificial
  Synthetic LukE_E297A
MGSSGLNDIFEAQKIEWHEGGHHHHHHHHHHSSGLVPRGSHMLENTNIENIGDGAEVIKRTEDVSSKKWGVTQNVQFDFVKDKKYNKDALIVKMQGFINSRTSFSDVKGSGYELTKRMIWPFQYNIGLTTKDPNVSLINYLPKNKIETTDVGQTLGYNIGGNFQSAPSIGGNGSFNYSKTISYTQKSYVSEVDKQNSKSVKWGVKANEFVTPDGKKSAHDRYLFVQSPNGPTGSAREYFAPDNQLPPLVQSGFNPSFITTLSHEKGSSDTSEFEISYGRNLDITYATLFPRTGIYAARKHNAFVNRNFVVRYEVNWKTHEIKVKGHN

SEQ ID NO: 1072 - protein, 327 aa, Artificial
  Synthetic LukE_K299A
MGSSGLNDIFEAQKIEWHEGGHHHHHHHHHHSSGLVPRGSHMLENTNIENIGDGAEVIKRTEDVSSKKWGVTQNVQFDFVKDKKYNKDALIVKMQGFINSRTSFSDVKGSGYELTKRMIWPFQYNIGLTTKDPNVSLINYLPKNKIETTDVGQTLGYNIGGNFQSAPSIGGNGSFNYSKTISYTQKSYVSEVDKQNSKSVKWGVKANEFVTPDGKKSAHDRYLFVQSPNGPTGSAREYFAPDNQLPPLVQSGFNPSFITTLSHEKGSSDTSEFEISYGRNLDITYATLFPRTGIYAERAHNAFVNRNFVVRYEVNWKTHEIKVKGHN

SEQ ID NO: 1073 - protein, 327 aa, Artificial
  Synthetic LukE_H300A
MGSSGLNDIFEAQKIEWHEGGHHHHHHHHHHSSGLVPRGSHMLENTNIENIGDGAEVIKRTEDVSSKKWGVTQNVQFDFVKDKKYNKDALIVKMQGFINSRTSFSDVKGSGYELTKRMIWPFQYNIGLTTKDPNVSLINYLPKNKIETTDVGQTLGYNIGGNFQSAPSIGGNGSFNYSKTISYTQKSYVSEVDKQNSKSVKWGVKANEFVTPDGKKSAHDRYLFVQSPNGPTGSAREYFAPDNQLPPLVQSGFNPSFITTLSHEKGSSDTSEFEISYGRNLDITYATLFPRTGIYAERKANAFVNRNFVVRYEVNWKTHEIKVKGHN

SEQ ID NO: 1074 - protein, 327 aa, Artificial
  Synthetic LukE_N301A
MGSSGLNDIFEAQKIEWHEGGHHHHHHHHHHSSGLVPRGSHMLENTNIENIGDGAEVIKRTEDVSSKKWGVTQNVQFDFVKDKKYNKDALIVKMQGFINSRTSFSDVKGSGYELTKRMIWPFQYNIGLTTKDPNVSLINYLPKNKIETTDVGQTLGYNIGGNFQSAPSIGGNGSFNYSKTISYTQKSYVSEVDKQNSKSVKWGVKANEFVTPDGKKSAHDRYLFVQSPNGPTGSAREYFAPDNQLPPLVQSGFNPSFITTLSHEKGSSDTSEFEISYGRNLDITYATLFPRTGIYAERKHAAFVNRNFVVRYEVNWKTHEIKVKGHN

SEQ ID NO: 1075 - protein, 327 aa, Artificial
  Synthetic LukE_F303A
MGSSGLNDIFEAQKIEWHEGGHHHHHHHHHHSSGLVPRGSHMLENTNIENIGDGAEVIKRTEDVSSKKWGVTQNVQFDFVKDKKYNKDALIVKMQGFINSRTSFSDVKGSGYELTKRMIWPFQYNIGLTTKDPNVSLINYLPKNKIETTDVGQTLGYNIGGNFQSAPSIGGNGSFNYSKTISYTQKSYVSEVDKQNSKSVKWGVKANEFVTPDGKKSAHDRYLFVQSPNGPTGSAREYFAPDNQLPPLVQSGFNPSFITTLSHEKGSSDTSEFEISYGRNLDITYATLFPRTGIYAERKHNAAVNRNFVVRYEVNWKTHEIKVKGHN

SEQ ID NO: 1076 - protein, 327 aa, Artificial
  Synthetic LukE_R306A
MGSSGLNDIFEAQKIEWHEGGHHHHHHHHHHSSGLVPRGSHMLENTNIENIGDGAEVIKRTEDVSSKKWGVTQNVQFDFVKDKKYNKDALIVKMQGFINSRTSFSDVKGSGYELTKRMIWPFQYNIGLTTKDPNVSLINYLPKNKIETTDVGQTLGYNIGGNFQSAPSIGGNGSFNYSKTISYTQKSYVSEVDKQNSKSVKWGVKANEFVTPDGKKSAHDRYLFVQSPNGPTGSAREYFAPDNQLPPLVQSGFNPSFITTLSHEKGSSDTSEFEISYGRNLDITYATLFPRTGIYAERKHNAFVNANFVVRYEVNWKTHEIKVKGHN

SEQ ID NO: 1077 - protein, 98 aa, Artificial
  Synthetic Luk26
MLPAPKNLVVSRVTEDSARLSWTAPDAAFDSFHIEYAEPWVWGEAIVLTVPGSERSYDLTGLKPGTEYVVFIGGVKGGHNSTPLSAIFTTGGHHHHHH

SEQ ID NO: 1078 - protein, 448 aa, Artificial
  Synthetic LukABHC111
EVQLQQSGAELVKPGASVKISCKASGYAFSSSWMNWLKQRPGKGLEWIGRIYPGDGDTNYNGKFKGKATLTADKSSSTAYMQLSSLTSEDSAVYFCARYGYDYDGEYYYAMDYWGQGTSVTVSSAKTTPPSVYPLAPGSAAQTNSMVTLGCLVKGYFPEPVTVTWNSGSLSSGVHTFPAVLESDLYTLSSSVTVPSSPRPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMNTNGSYFVYSKLNVQKSNWEAGNTFTCSVLHEGLHNHHTEKSLSHSPGK

SEQ ID NO: 1079 - protein, 215 aa, Artificial
  Synthetic LukABLC111
DIVMTQSPTTMAASPGERITITCSAHSNLISNYLHWYQQKPGFSPKLLIYRTSNLASGVPARFSGSGSGTSYSLTIGTMEAEDVATYFCQQGSSIPFTFGSGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 1080 - protein, 233 aa, Artificial
  Synthetic FabHC214
EVQLQQSGAELVKPGASVKISCKASGYAFSSSWMNWLKQRPGKGLEWIGRIYPGDGDTNYNGKFKGKATLTADKSSSTAYMQLSSLTSEDSAVYFCARYGYDYDGEYYYAMDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCHHHHHH

SEQ ID NO: 1081 - protein, 215 aa, Artificial
  Synthetic FabLC214
DIVMTQSPTTMAASPGERITITCSAHSNLISNYLHWYQQKPGFSPKLLIYRTSNLASGVPARFSGSGSGTSYSLTIGTMEAEDVATYFCQQGSSIPFTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1082 - protein, 229 aa, Artificial
  Synthetic FabHC229
EVQLVETGGGLVKPGGSLRLSCSASRFSFRDYYMTWIRQAPGKGPEWVSHISGSGSTIYYADSVRGRFTISRDNAKSSLYLQMDSLQADDTAVYYCARGGRATSYYWVHWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCHHHHHH

SEQ ID NO: 1083 - protein, 214 aa, Artificial; identical to SEQ ID NO: 61
  Synthetic FabLC229

SEQ ID NO: 1084 - protein, 28 aa, Artificial
  Synthetic TD peptide
TDTDTDTDTDTDTDTDTDTDHHHHHHHH

SEQ ID NO: 1085 - protein, 28 aa, Artificial
  Synthetic SD-GlcNAc peptide
SDSDSDSDSDSDSDSDSDSDHHHHHHHH

SEQ ID NO: 1086 - protein, 325 aa, Artificial
  Synthetic Hla H35L toxoid
MKTRIVSSVTTTLLLGSILMNPVANAADSDINIKTGTTDIGSNTTVKTGDLVTYDKENGMLKKVFYSFIDDKNHNKKLLVIRTKGTIAGQYRVYSEEGANKSGLAWPSAFKVQLQLPDNEVAQISDYYPRNSIDTKEYMSTLTYGFNGNVTGDDTGKIGGLIGANVSIGHTLKYVQPDFKTILESPTDKKVGWKVIFNNMVNQNWGPYDRDSWNPVYGNQLFMKTRNGSMKAADNFLDPNKASSLLSSGFSPDFATVITMDRKASKQQTNIDVIYERVRDDYQLHWTSTNWKGTNTKDKWIDRSSERYKIDWEKEEMTNHHHHHH

SEQ ID NO: 1087 - protein, 93 aa, Artificial
  Synthetic Luk957 Hla binding FN3 domain
LPAPKNLVVSRVTEDSARLSWGEAPIWVAFDSFLIQYQESEKVGEAIVLTVPGSERSYDLTGLKPGTEYTVSIYGVFQPNNFHSNPLSAIFTT

SEQ ID NO: 1088 - protein, 96 aa, Artificial
  Synthetic Luk958 Hla binding FN3 domain
LPAPKNLVVSRVTEDSARLSWEANAWDDVNFDSFLIQYRESEKVGEAIVLTVPGSERSYDLTGLKPGTEYTVSIYGVWNQTHYRWPSNPLSAIFTT

SEQ ID NO: 1089 - protein, 91 aa, Artificial
  Synthetic Luk959 Hla binding FN3 domain
LPAPKNLVVSRVTEDSARLSWTYIFPIFDSFLIQYQESEKVGEAIVLTVPGSERSYDLTGLKPGTEYTVSIYGVLQYFEFTSNPLSAIFTT

SEQ ID NO: 1090 - protein, 95 aa, Artificial
  Synthetic Luk960 Hla binding FN3 domain
LPAPKNLVVSRVTEDSARLSWDSEELFLFDSFLIQYQESEKVGEAIVLTIPGSERSYDLTGLKPGTEYTVSIYGVWGHWDWYWKTSNPLSAIFTT

SEQ ID NO: 1091 - protein, 95 aa, Artificial
  Synthetic Luk961 Hla binding FN3 domain
LPAPKNLVVSRVTEDSARLSWDSEELFLFDSFLIQYQESEKVGEAIVLTVPGSERSYDLTGLKPGTEYTVSIYGVWGHWDWYWKTSNPLSAIFTT

SEQ ID NO: 1092 - protein, 93 aa, Artificial
  Synthetic Luk962 Hla binding FN3 domain
LPAPKNLVVSRVTEDSARLSWKVEHEFDSFLIQYQESEKVGEAIVLTVPGSERSYDLTGLKPGTEYTVSIYGVGDSQWYFWRFSNPLSAIFTT

SEQ ID NO: 1093 - protein, 95 aa, Artificial
  Synthetic Luk963 Hla binding FN3 domain
LPAPKNLVVSRVTEDSARLSWGEEVHWLFDSFLIQYQESEKVGEAIVLTVPGSERSYDLTSLKPGTEYTVSIYGVAGYAHWFTTWSNPLSAIFTT

SEQ ID NO: 1094 - protein, 95 aa, Artificial
  Synthetic Luk964 Hla binding FN3 domain
LPAPKNLVVSRVTEDSARLSWAPSHFPRSFDSFLIQYQESEKVGEAIVLTVPGSERSYDLTGLKPGTEYTVSIYGVLTVATIRWQSNPLSAIFTT

SEQ ID NO: 1095 - protein, 95 aa, Artificial
  Synthetic Luk965 Hla binding FN3 domain
LPAPKNLVVSRVTEDSARLSWDEQLWIQFDSFLIQYQESEKVGEAIVLTVPGSERSYDLTGLKPGTEYTVSIYGVVPWLPNYWQVSNPLSAIFTT

SEQ ID NO: 1096 - protein, 96 aa, Artificial
  Synthetic Luk966 Hla binding FN3 domain
LPAPKNLVVSRVTEDSARLSWWSENWVNWFDSFLIQYQESEKVGEAIVLTVPGSERSYDLTGLKPGTEYTVSIYGVWEVKNRIRWLSNPLSAIFTT

SEQ ID NO: 1097 - protein, 96 aa, Artificial
  Synthetic Luk967 Hla binding FN3 domain
LPAPKNLVVSRVTEDSARLSWEANAWDDVNFDSFLIQYQESEKVGEAIVLTVPGSERSYDLTGLKPGTEYTVSIYGVWNQTHYRWPSNPLSAIFTT

SEQ ID NO: 1098 - protein, 95 aa, Artificial
  Synthetic Luk968 Hla binding FN3 domain
LPAPKNLVVSRVTEDSARLSWVDKRHPDFDSFLIQYQESEKVGEAIVLTVPGSERSYDLTGLKPGTEYTVSIYGVHGFLQWYWSTSNPLSAIFTT

SEQ ID NO: 1099 - protein, 97 aa, Artificial
  Synthetic Luk969 Hla binding FN3 domain
LPAPKNLVVSRVTEDSARLSWNSEIAEQFFFDSFLIQYQESEKVGEAIVLTVPGSERSYDLTGLKPGTEYTVSIYGVWGHWDWYWKTSNPLSAIFTT

SEQ ID NO: 1100 - protein, 93 aa, Artificial
  Synthetic Luk970 Hla binding FN3 domain
LPAPKNLVVSRVTEDSARLSWNRGLIPFDSFLIQYQESEKVGEAIVLTVPGSERSYDLTGLKLGTEYTVSIYGVGTYYPWWPLSNPLSAIFTT

SEQ ID NO: 1101 - protein, 95 aa, Artificial
  Synthetic Luk971 Hla binding FN3 domain
LPAPKNLVVSRVTEDSARLSWSPWFFGQFDSFLIQYQESEKVGEAIVLTVPGSERSYDLTGLKPGTEYTVSIYGVIELGQQYSFTSNPLSAIFTT

SEQ ID NO: 1102 - protein, 97 aa, Artificial
  Synthetic Luk972 Hla binding FN3 domain
LPAPKNLVVSRVTEDSARLSWNSEIAEQFFFDSFLIQYQESEKVGEAIVLTVPGSERSYDLTGLKPGTEYTVSIYGVWGHWDWYWKTSNPLSAIVTT

SEQ ID NO: 1103 - protein, 94 aa, Artificial
  Synthetic Luk973 Hla binding FN3 domain
LPAPKNLVVSRVTEDSARLSWTAPDAAFDSFGIGYPEFYRKGEAIQLRVPGSERSYDLTGLKPGTEYTVSIYGVSDLTTHWWLLSNPLSAIFTT

SEQ ID NO: 1104 - protein, 95 aa, Artificial
  Synthetic Luk974 Hla binding FN3 domain
LPAPKNLVVSRVTEDSARLSWGEEVHWLFDSFLIQYQESEKVGEAIVLTVPGSERSYDLTGLKPGTEYTVSIYGVAGYAHWFTTWSNPLSAIFTT

SEQ ID NO: 1105 - protein, 89 aa, Artificial
  Synthetic Luk975 Hla binding FN3 domain
LPAPKNLVVSRVTEDSARLSWTAPDAAFDSFAISYQELDPEGEAINLSVPGSERSYDLTGLKPGTKYLVTIDGVKGGKASKPLPANFTT

SEQ ID NO: 1106 - protein, 95 aa, Artificial
  Synthetic Luk976 Hla binding FN3 domain
LPAPKNLVVSRVTEDSARLSWDTLTPWIIFDSFLIQYQESEKVGEAIVLTVPGSERSYDLTGLKPGTEYTVSIYGVQPWQVYYQYSNPLSAIFTT

SEQ ID NO: 1107 - protein, 97 aa, Artificial
  Synthetic Luk977 Hla binding FN3 domain
LPAPKNLVVSRVTEDSARLSWGASIERSRWFDSFLIQYQESEKVGEAIVLTVPGSERSYDLTGQKPGTEYTVSIYGVHNVPNLFVQGSNPLSAIFTT

SEQ ID NO: 1108 - protein, 92 aa, Artificial
  Synthetic Luk978 Hla binding FN3 domain
LPAPKNLVVSRVTEDSARLSWKAYHFIFDSFLIQYQESEKVGEAIVLTVPGSERSYDLTGLKPGTEYTVSIYGVRSDYVYWASNPLSAIFTT

SEQ ID NO: 1109 - protein, 94 aa, Artificial
  Synthetic Luk979 Hla binding FN3 domain
LPAPKNLVVSRVTEDSARLSWQIFPAFARFDSFLIQYQESEKVGEAIVLTVPGSERSYDLTGLKPGTEYTVSIYGVIFGPHTFQSNPLSAIFTT

SEQ ID NO: 1110 - protein, 91 aa, Artificial
  Synthetic Luk980 Hla binding FN3 domain
LPAPKNLVVSRVTEDSARLSWRISFPHFDSFLIQYQESEKVGEAIVLTVRGSERSYDLTGLKPGTEYTVSIYGVLWYWRAYSNPLSAIFTT

SEQ ID NO: 1111 - protein, 96 aa, Artificial
  Synthetic Luk981 Hla binding FN3 domain
LPAPKNLVVSRVTEDSARLSWEANAWDDVNFDSFLIQYQESEKVGDAIVLTVPGSERSYDLTGLKPGTEYTVSIYGVWNQTHYRWPSNPLSAIFTT

SEQ ID NO: 1112 - protein, 89 aa, Artificial
  Synthetic Luk982 Hla binding FN3 domain
LPAPKNLVVSRVTEDSARLSWTAPDAAFDSFAIGYPEYHDAGEAIHLFVPGSERSYDLTGLKPGTEYVVAIRGVKGGHASEPLHAHFTT

SEQ ID NO: 1113 - protein, 96 aa, Artificial
  Synthetic Luk983 Hla binding FN3 domain
LPAPKNLVVSRVTEDSARLSWKRNGVFEVNFDSFLIQYQESEKVGEAIVLTVPGSERSYDLTGLKPGTEYTVSIYGVWNQTHYRWPSNPLSAIFTT

SEQ ID NO: 1114 - protein, 96 aa, Artificial
  Synthetic Luk984 Hla binding FN3 domain
LPAPKNLVVSRVTEDSARLSWFVTWRNGFFDSFLIQYQESEKVGEAIVLTVPGSERSYDLTGLKPGTEYTVSIYGVVHQYYPHYWFSNPLSAIFTT

SEQ ID NO: 1115 - protein, 96 aa, Artificial
  Synthetic Luk985 Hla binding FN3 domain
LPAPKNLVVSRVTEDSARLSWKRNGVFEVNFDSFLIQYRESEKVGEAIVLTVPGSERSYDLTGLKPGTEYTVSIYGVWNQTHYRWPSNPLSAIFTT

SEQ ID NO: 1116 - protein, 94 aa, Artificial
  Synthetic Luk986 Hla binding FN3 domain
LPAPKNLVVSRVTEDSARLSWTAPDAAFDSFLIQYQESEKVGEAIVLTVPGSERSYDLTGLKPGTEYTVSIYGVITLLFNGAVLSNPLSAIFTT

SEQ ID NO: 1117 - protein, 95 aa, Artificial
  Synthetic Luk987 Hla binding FN3 domain
LPAPKNLVVSRVTEDSARLSWVDKRHPDFDSFLIQYQESEKVGEAIVLTVSGSERSYDLTGLKPGTEYTVSIYGVHGFLQWYWSTSNPLSAIFTT

SEQ ID NO: 1118 - protein, 95 aa, Artificial
  Synthetic Luk988 Hla binding FN3 domain
LPAPKNLVVSRVTEDSARLSWAPSHFPRSFDSFLIQYQESEKVGEAIVLTVPGSERSYDLTGLKPGTEYTVSIYGVLTVATIRWQSDPLSAIFTT

SEQ ID NO: 1119 - protein, 89 aa, Artificial
  Synthetic Luk989 Hla binding FN3 domain
LPAPKNLFVSRVTEDSARLSWTAPDAAFDSFFIRYVEYGQPGEAIPLDVPGSERSYDLTGLKPGTEYGVSINGVKGGNRSSPLFARFTT

SEQ ID NO: 1120 - protein, 87 aa, Artificial
  Synthetic Luk990 Hla binding FN3 domain
LPAPKNLVVSRVTEDSARLSWTAPDAAFDSFSISYKEWWAVGEAIFLHVPGSERSYDLTGLKPGTEYHVPISGVKGGDKSLPAHFTT

SEQ ID NO: 1121 - protein, 89 aa, Artificial
  Synthetic Luk991 Hla binding FN3 domain
LPAPKNLVVSRVTEDSARLSWTAPDAAFDSFGIHYGELWWNGEAIALVVPGSERSYDLTGLKPGTEYKVWIPGVKGGSQSKPLWAFFTT

SEQ ID NO: 1122 - protein, 89 aa, Artificial
  Synthetic Luk992 Hla binding FN3 domain
LPAPKNLVVSRVTEDSARLSWTAPDAAFDSFYIYYVEKPDPGEAIELYVPGSERSYDLTGLKPGTEYRVRIEGVKGGDHSFPLVAGFTT

SEQ ID NO: 1123 - protein, 89 aa, Artificial
  Synthetic Luk993 Hla binding FN3 domain
LPAPKNLVVSRVTEDSARLSWTAPDAAFDSFIIEYWEERQRGEAIGLTVPGSERSYDLTGLKPGTEYRVIIVGVKGGTYSVPLEAFFTT

SEQ ID NO: 1124 - protein, 89 aa, Artificial
  Synthetic Luk994 Hla binding FN3 domain
LPAPKNLVVSRVTEDSARLSWTAPDAAFDSFGIEYHEPSKWGEAIGLNVPGSERSYDLTGLKPGTEYSVQIKGVKGGWWSHPLPAAFTT

SEQ ID NO: 1125 - protein, 88 aa, Artificial
  Synthetic Luk995 Hla binding FN3 domain
LPAPKNLVVSRVTEDSARLSWTAPDAAFDSFYIKYGEGNHGEAIWLFVPGSERSYDLTGLKPGTEYYVEIVGVKGGFPSQPLHAQFTT

SEQ ID NO: 1126 - protein, 89 aa, Artificial
  Synthetic Luk996 Hla binding FN3 domain
LPAPKNLVVSRVTEDSARLSWTAPDAAFDSFKIDYIEIDVEGEAIYLFVPGSERSYDLTGLKPGTEFRVRIPGVKGGDHSVPLAAAFTT

SEQ ID NO: 1127 - protein, 89 aa, Artificial
  Synthetic Luk997 Hla binding FN3 domain
LPAPKNLVVSRVTEDSARLSWTAPDAAFDSFIISYPEYWAIGEAIPLFVPGSERSYDLTGLKPGTEYIVIIPGVKGGKGSNPLWAIFTT

SEQ ID NO: 1128 - protein, 89 aa, Artificial
  Synthetic Luk998 Hla binding FN3 domain
LPAPKNLVVSRVTEDSARLSWTAPDAAFDSFEIGYFAEVDPGEAIQLDVPGSERSYDLTGLKPGTEYAVNIPGVKGGYKSDPLNAHSTT

SEQ ID NO: 1129 - protein, 89 aa, Artificial
  Synthetic Luk999 Hla binding FN3 domain
LPAPKNLVVSRVTEDSVRLSWTAPDAAFDSFDIPYQELNRKGEAIQLTVPGSESSYDLTGLKPGTEYKVHIRGVKGGKQSLPLIAGFTT

SEQ ID NO: 1130 - protein, 89 aa, Artificial
  Synthetic Luk1000 Hla binding FN3 domain
LPAPKNLVVSRVTEDSARLSWTAPDAAFDSFEITYHEIYKFGEAITLQVPGSERSYDLTGLKPGTEYRVRITGVKGGWKSQPLVAKFTT

SEQ ID NO: 1131 - protein, 89 aa, Artificial
  Synthetic Luk1001 Hla binding FN3 domain
LPAPKNLVVSRVTEDSARLSWTAPDAAFDSFDIRYDEEGYWGEAIPLHVPGSERSYDLTGLKPGTEYTVWIYGVKGGRKSVPLVAEFTT

SEQ ID NO: 1132 - protein, 89 aa, Artificial
  Synthetic Luk1002 Hla binding FN3 domain
LPAPKNLVVSRVTEDSARLSWTAPDAAFDSFNIRYKEPHRQGEAIPLIVPGSERSYDLTGLKPGTEYNVHIHGVKGGKWSIPLYAWFTT

SEQ ID NO: 1133 - protein, 89 aa, Artificial
  Synthetic Luk1003 Hla binding FN3 domain
LPAPKNLVVSRVTEDSARLSWTAPDAAFDSFDISYWEQVWQGEAIVLVVPGSERSYDLTGLKPGTEYPVFIRGVKGGSQSGPLRAFFTT

SEQ ID NO: 1134 - protein, 89 aa, Artificial
  Synthetic Luk1004 Hla binding FN3 domain
LPAPKNLVVSRVTEDSARLSWTAPDAAFDSFYIYYYEFFRNGEAIVLFVPGSERSYDLTGLKPGTEYWVRIKGVKGGRDSHPLYAGFTT

SEQ ID NO: 1135 - protein, 89 aa, Artificial
  Synthetic Luk1005 Hla binding FN3 domain
LPAPKNLVVSRVTEDSARLSWTAPDAAFDSFSIGYHEVQQTGEAIRLFVPGSERSYDLTGLKPGTEYEVEIRGVKGGTTSIPLWAHFTT

SEQ ID NO: 1136 - protein, 89 aa, Artificial
  Synthetic Luk1006 Hla binding FN3 domain
LPAPKNLVVSRVTEDSARLSWTAPDAAFDSFGITYEEPHEIGEAIFLVVPGSERSYDLTGLKPGTEYYVEIQGVKGGDPSDPLNAAFTT

SEQ ID NO: 1137 - protein, 90 aa, Artificial
  Synthetic Luk1007 Hla binding FN3 domain
LPAPKNLVVSRVTEDSARLSWTAPDAAFDSFAIHYREWSIWGEAIDLVVPGSERSYDLTGLKPGTEYIVIIPGVKGGYVSNPLFAFFTTT

SEQ ID NO: 1138 - protein, 89 aa, Artificial
  Synthetic Luk1008 Hla binding FN3 domain
LPAPKNLVVSRVTEDSARLSWTAPDAAFDSFHIYYSERQRIGEAIILVVPGSERSYDLTGLKPGTEYIVKINGVKGGIISQPLIAPFTT

SEQ ID NO: 1139 - protein, 89 aa, Artificial
  Synthetic Luk1009 Hla binding FN3 domain
LPAPKNLVVSRVTEDSARLSWTAPDAAFDSFNITYVEPVTEGEAISLVVPGSERSYDLTGLKPGTEYSVKIHGVKGGPASNPLYAKFTT

SEQ ID NO: 1140 - protein, 89 aa, Artificial
  Synthetic Luk1010 Hla binding FN3 domain
LPAPKNLVVSRVTEDSARLSWTAPDAAFDSFKIKYKEERHIGEAIHLGVPGSERSYDLTGLKPGTEYEVYIVGVKGGSSSSPLFAHFTT

SEQ ID NO: 1141 - protein, 89 aa, Artificial
  Synthetic Luk1011 Hla binding FN3 domain
LPAPKNLVVSRVTEDSARLSWTAPDAAFDSFRITYWEDNSTGEAILLVVPGSERSYDLTGLKPGTEYRVAIVGVKGGDDSWPLLATFTT

SEQ ID NO: 1142 - protein, 89 aa, Artificial
  Synthetic Luk1012 Hla binding FN3 domain
LPAPKNLVVSRVTEDSARLSWTAPDAAFDSFFILYVEYSVNGEAIELSVPGSERSYDLTGLKPGTEYDVIIGGVKGGNHSKPLVAFFTT

SEQ ID NO: 1143 - protein, 89 aa, Artificial
  Synthetic Luk1013 Hla binding FN3 domain
LPAPKNLVVSRVTEDSARLSWTAPDAAFDSFAIHYREWFIWGEAIDLVVPGSERSYDLTGLKPGTEYIVIIPGVKGGYVSNPLFAFFTT

SEQ ID NO: 1144 - protein, 89 aa, Artificial
  Synthetic Luk1014 Hla binding FN3 domain
LPAPKNLVVSRVTEDSARLSWTAPDAAFDSFGIGYRELGGLGEAIVLTVPGSERSYDLTGLKPGTEYYVVIPGVKGGGLSLPLSAIFTT

SEQ ID NO: 1145 - protein, 89 aa, Artificial
  Synthetic Luk1015 Hla binding FN3 domain
LPAPKNLVVSRVTEDSARLSWTALDAAFDSFGIPYRELGRGGEAIVLTVPGSERSYDLTGLKPGTEYVVYITGVKGGMISTPLSAIFTT

SEQ ID NO: 1146 - protein, 89 aa, Artificial
  Synthetic Luk1016 Hla binding FN3 domain
LPAPKNLVVSRVTEDSARLSWTAPDAAFDSFGIPYRELGRGGEAIVLTVPGSERSYDLTGLKPGTEYVVYITGVKGGMISTPLSAIFTT

SEQ ID NO: 1147 - protein, 89 aa, Artificial
  Synthetic Luk1017 Hla binding FN3 domain
LPAPKNLVVSRVTEDSARLSWTAPDAAFDSFWIHYREVPVPGEAIVLTVPGSERSYDLTGLKPGTEYFVYIMGVKGGTFSAPLSAIFTT

SEQ ID NO: 1148 - protein, 89 aa, Artificial
  Synthetic Luk1018 Hla binding FN3 domain
LPAPKNLVVSRVTEDSACLSWTAPDAAFDSFGIPYRELGRGGEAIVLTVPGSERSYDLTGLKPGTEYVVYITGVKGGMISTPLSAIFTT

SEQ ID NO: 1149 - protein, 348 aa, Artificial
  Synthetic LukA mut1
MNSAHHHHHHHHHHGGGLNDIFEAQKIEWHEGSHKDSQDQNKKEHVDKSQQKDKRNVTNKDKNSTAPDDIGKNGKITKRTETVYDEKTNILQNLQFDFIDDPTYDKNVLLVKKQGSIHSNLKFESHKEEKNSNWLKYPSEYHVDFQVKRNRKTEILDQLPKNKISTAKVDSTFKFDSTKGIGRTSSNSYSKTISYNQQNYDTIASGKNNNWHVHWSVIANDLKYGGEVKNRNDELLFYRNTRIATVENPELSFASKYRYPALVRSGFNPEFLTYLSNEKSNEKTQFEVTYTRNQDILKNRPGIHYAPPILEKNKDGQRLIVTYEVDWKNKTVKVVDKYSDDNKPYKAG

SEQ ID NO: 1150 - protein, 305 aa, Artificial
  Synthetic LukB mut1
MKINSEIKQVSEKNLDGDTKMYTRTATTSDSQKNITQSLQFNFLTEPNYDKETVFIKAKGTIGSGLRILDPNGYWNSTLRWPGSYSVSIQNVDDNNNTNVTDFAPKNQDESREVKYTYGYKTINRGGLTGNITKESNYSETISYQQPSYRTLLDQSTSHKGVGWKVEAHLINNMGHDHTRQLTNDSDNRTKSEIFSLTRNGNLWAKDNFTPKDKMPVTVSEGFNPEFLAVMSHDKKDKGKSQFVVHYKRSMDEFKIDWNRHGFWGYWSGENHVDKKEEKLSALYEVDWKTHNVKFVKVLNDNEKK

SEQ ID NO: 1151 - protein, 305 aa, Artificial
  Synthetic LukB mut2
MKINSEIKQVSEKNLDGDTKMYTRTATTSDSQKNITQSLQFNFLTEPNYDKETVFIKAKGTIGSGLRILDPNGYWNSTLRWPGSYSVSIQNVDDNNNTNVTDFAPKNQDESREVKYTYGYKTGGDFSINRNITKESNYSETISYQQPSYRTLLDQSTSHKGVGWKVEAHLINNMGHDHTRQLTNDSDNRTKSEIFSLTRNGNLWAKDNFTPKDKMPVTVSEGFNPEFLAVMSHDKKDKGKSQFVVHYKRSMDEFKIDWNRHGFWGYWSGENHVDKKEEKLSALYEVDWKTHNVKFVKVLNDNEKK

SEQ ID NO: 1152 - protein, 115 aa, Artificial
  Synthetic TENCON_HIS_SA
MLPAPKNLVVSRVTEDSARLSWTAPDAAFDSFLIQYQESEKVGEAIVLTVPGSERSYDLTGLKPGTEYTVSIYGVKGGHRSNPLSAIFTTGGHHHHHHGGGLNDIFEAQKIEWHE

SEQ ID NO: 1153 - protein, 115 aa, Artificial
  Synthetic Luk17_HIS_SA
MLPAPKNLVVSRVTEDSARLSWTAPDAAFDSFWITYEEKFYRGEAIVLTVPGSERSYDLTGLKPGTEYKVWIVGVKGGQGSWPLSAIFTTGGHHHHHHGGGLNDIFEAQKIEWHE

SEQ ID NO: 1154 - protein, 120 aa, Artificial
  Synthetic Luk19_HIS_SA
MLPAPKNLVVSRVTEDSARLSWYHAIHRLNHFDSFLIQYQESEKVGEAIVLTVPGSERSYDLAGLKPGTEYTVSIYGVLPDAFVSSNPLSAIFTTGGHHHHHHGGGLNDIFEAQKIEWHE

SEQ ID NO: 1155 - protein, 115 aa, Artificial
  Synthetic Luk26_HIS_SA
MLPAPKNLVVSRVTEDSARLSWTAPDAAFDSFHIEYAEPWVWGEAIVLTVPGSERSYDLTGLKPGTEYVVFIGGVKGGHNSTPLSAIFTTGGHHHHHHGGGLNDIFEAQKIEWHE

SEQ ID NO: 1156 - protein, 125 aa, Artificial
  Synthetic Luk31_HIS_SA
MLPAPNNLVVSRVTEDSARLSWDWDKYYTNRFDSFLIQYQESEKVGEAIVLTVPGSERSYDLTGLKPGTEYTVSIYGVLVRDYIRAAEWYSNPLSAIFTTGGHHHHHHGGGLNDIFEAQKIEWHE

SEQ ID NO: 1157 - protein, 122 aa, Artificial
  Synthetic Luk32_HIS_SA
MLPAPKNLVVSRVTEDSARLSWYHENAYLLFDSFLIQYQESEKVGEAIVLTVPGSERSYDLTGLKPGTEYTVSIYGVVYDLTPEKRSSNPLSAIFTTGGHHHHHHGGGLNDIFEAQKIEWHE

SEQ ID NO: 1158 - protein, 115 aa, Artificial
  Synthetic Luk163_HIS_SA
MLPAPKNLVVSRVTEDSARLSWTAPDAAFDSFYIEYWEPTSDGEAIALNVPGSERSYDLTGLKPGTEYFVEIWGVKGGPRSPPLSAWFTTGGHHHHHHGGGLNDIFEAQKIEWHE

SEQ ID NO: 1159 - protein, 115 aa, Artificial
  Synthetic Luk174_HIS_SA
MLPAPKNLVVSRVTEDSARLSWTAPDAAFDSFDIEYGEPEKIGEAIWLTVPGSERSYDLTGLKPGTEYWVFIYGVKGGALSRPLTATFTTGGHHHHHHGGGLNDIFEAQKIEWHE

SEQ ID NO: 1160 - protein, 115 aa, Artificial
  Synthetic Luk187_HIS_SA
MLPAPKNLVVSRVTEDSARLSWTAPDAAFDSFRILYFEYKRLGEAIVLTVPGSERSYDLTGLKPGTEYFVGIHGVKGGYISRPLSAIFTTGGHHHHHHGGGLNDIFEAQKIEWHE

SEQ ID NO: 1161 - protein, 115 aa, Artificial
  Synthetic Luk188_HIS_SA
MLPAPKNLVVSRVTEDSARLSWTAPDAAFDSFHIHYWEFNPAGEAIVLTVPGSERSYDLTGLKPGTEYFVGIHGVKGGGISWPLSAIFTTGGHHHHHHGGGLNDIFEAQKIEWHE

SEQ ID NO: 1162 - protein, 114 aa, Artificial
  Synthetic Luk311_HIS_SA
MLPAPKNLVVSRVTEDSARLSWTAPDAAFDSFWISYVEPDDGEAIELLVPGSERSYDLTGLKPGTEYIVQIDGVKGGTTSVPLNARFTTGGHHHHHHGGGLNDIFEAQKIEWHE

SEQ ID NO: 1163 - protein, 559 aa, Artificial
  Synthetic HC431
QVQLQQSGAELMNPGASVKISCKSTGYKFSSYWIEWVKQRPGHGLEWMGEILPGSGSTNHNEKFKGKAIFTADASSNTAYMELSSLTSEDSAVYYCARTISTATDWFAYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPDVFLFPPKPKDTLMISRTPEVTCVVVDVSHEDPEVKFNWYVDGVEVHNAKTKPREEQYNSTYRVVSVLTVLHQDWLNGKEYKCKVSNAALPAPIAKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNRFTQKSLSLSPGKGGGGSGGGGSGGGGSGGGGSMLPAPKNLVVSRVTEDSARLSWTAPDAAFDSFWITYEEKFYRGEAIVLTVPGSERSYDLTGLKPGTEYKVWIVGVKGGQGSWPLSAIFTT

SEQ ID NO: 1164 - protein, 219 aa, Artificial
  Synthetic LC431
DVLMTQTPLSLPVSLGDQASISCRSSQTIVYSDGNTYLEWYLQKPGQSPKLLIYKVSNRFSGVPDRVSGSGSGTDFTLKISRVEAEDLGVYYCFQGSHVPYTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1165 - protein, 559 aa, Artificial
  Synthetic HC432
EVQLQQSGGGLVKPGGSLKLSCAASGFTFSSYAMSWVRQTPEKRLEWVATITGGGTYTYYLDSVKGRFTISRDNAKTSLYLQMSSLRSEDTAMYYCARHRDGNYGCFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPDVFLFPPKPKDTLMISRTPEVTCVVVDVSHEDPEVKFNWYVDGVEVHNAKTKPREEQYNSTYRVVSVLTVLHQDWLNGKEYKCKVSNAALPAPIAKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNRFTQKSLSLSPGKGGGGSGGGGSGGGGSGGGGSMLPAPKNLVVSRVTEDSARLSWTAPDAAFDSFWITYEEKFYRGEAIVLTVPGSERSYDLTGLKPGTEYKVWIVGVKGGQGSWPLSAIFTT

SEQ ID NO: 1166 - protein, 215 aa, Artificial
  Synthetic LC432
DIVLTQSPAIMSASLGERVTMTCTASSSVSSSYLHWYQQKPGSSPKLWVYSTSNLASGVPARFSGSGSGSSYSLTISSMEPEDTATYYCHQYHRSPQTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1167 - protein, 559 aa, Artificial
  Synthetic HC505
QVQLQQSGAELMNPGASVKISCKSTGYKFSSYWIEWVKQRPGHGLEWMGEILPGSGSTNHNEKFKGKAIFTADASSNTAYMELSSLTSEDSAVYYCARTISTATDWFAYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPDVFLFPPKPKDTLMISRTPEVTCVVVDVSHEDPEVKFNWYVDGVEVHNAKTKPREEQYNSTYRVVSVLTVLHQDWLNGKEYKCKVSNAALPAPIAKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSMLPAPKNLVVSRVTEDSARLSWTAPDAAFDSFWITYEEKFYRGEAIVLTVPGSERSYDLTGLKPGTEYKVWIVGVKGGQGSWPLSAIFTT

SEQ ID NO: 1168 - protein, 219 aa, Artificial; identical to SEQ ID NO: 1164
  Synthetic LC505

SEQ ID NO: 1169 - protein, 559 aa, Artificial
  Synthetic HC506
EVQLQQSGGGLVKPGGSLKLSCAASGFTFSSYAMSWVRQTPEKRLEWVATITGGGTYTYYLDSVKGRFTISRDNAKTSLYLQMSSLRSEDTAMYYCARHRDGNYGCFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPDVFLFPPKPKDTLMISRTPEVTCVVVDVSHEDPEVKFNWYVDGVEVHNAKTKPREEQYNSTYRVVSVLTVLHQDWLNGKEYKCKVSNAALPAPIAKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSMLPAPKNLVVSRVTEDSARLSWTAPDAAFDSFWITYEEKFYRGEAIVLTVPGSERSYDLTGLKPGTEYKVWIVGVKGGQGSWPLSAIFTT

SEQ ID NO: 1170 - protein, 215 aa, Artificial; identical to SEQ ID NO: 1166
  Synthetic LC506

SEQ ID NO: 1171 - protein, 208 aa, Artificial
  Synthetic Luk047001 (SAFN3-TENCON)
MLPAPKNLVVSRVTEDSARLSWTAPDAAFDSFHIEYWEQSIVGEAIVLTVPGSERSYDLTGLKPGTEYRVWIYGVKGGNDSWPLSAIFTTGGGGSGGGGSGGGGSGGGGSMLPAPKNLVVSRVTEDSARLSWTAPDAAFDSFLIQYQESEKVGEAIVLTVPGSERSYDLTGLKPGTEYTVSIYGVKGGHRSNPLSAIFTTGGHHHHHH

SEQ ID NO: 1172 - protein, 170 aa, Artificial
  Synthetic Luk047002 (SABD-TENCON)
MTIDEWLLKEAKEKAIEELKKAGITSDYYFDLINKAKTVEGVNALKDEILKAGGGGSGGGGSGGGGSGGGGSMLPAPKNLVVSRVTEDSARLSWTAPDAAFDSFLIQYQESEKVGEAIVLTVPGSERSYDLTGLKPGTEYTVSIYGVKGGHRSNPLSAIFTTGGHHHHHH

SEQ ID NO: 1173 - protein, 208 aa, Artificial
  Synthetic Luk047003 (TFFN3-TENCON)
MLPAPKNLVVSRVTEDSARLSWTAPDAAFDSFAIEYEELRDWGEAIVLTVPGSERSYDLTGLKPGTEYSVSITGVKGGAESWPLSAIFTTGGGGSGGGGSGGGGSGGGGSMLPAPKNLVVSRVTEDSARLSWTAPDAAFDSFLIQYQESEKVGEAIVLTVPGSERSYDLTGLKPGTEYTVSIYGVKGGHRSNPLSAIFTTGGHHHHHH

SEQ ID NO: 1174 - protein, 208 aa, Artificial
  Synthetic Luk047004 (SAFN3-LukE26)
MLPAPKNLVVSRVTEDSARLSWTAPDAAFDSFHIEYWEQSIVGEAIVLTVPGSERSYDLTGLKPGTEYRVWIYGVKGGNDSWPLSAIFTTGGGGSGGGGSGGGGSGGGGSMLPAPKNLVVSRVTEDSARLSWTAPDAAFDSFHIEYAEPWVWGEAIVLTVPGSERSYDLTGLKPGTEYVVFIGGVKGGHNSTPLSAIFTTGGHHHHHH

SEQ ID NO: 1175 - protein, 170 aa, Artificial
  Synthetic Luk047005 (SABD-LukE26)
MTIDEWLLKEAKEKAIEELKKAGITSDYYFDLINKAKTVEGVNALKDEILKAGGGGSGGGGSGGGGSGGGGSMLPAPKNLVVSRVTEDSARLSWTAPDAAFDSFHIEYAEPWVWGEAIVLTVPGSERSYDLTGLKPGTEYVVFIGGVKGGHNSTPLSAIFTTGGHHHHHH

SEQ ID NO: 1176 - protein, 208 aa, Artificial
  Synthetic Luk047006 (TFFN3-LukE26)
MLPAPKNLVVSRVTEDSARLSWTAPDAAFDSFAIEYEELRDWGEAIVLTVPGSERSYDLTGLKPGTEYSVSITGVKGGAESWPLSAIFTTGGGGSGGGGSGGGGSGGGGSMLPAPKNLVVSRVTEDSARLSWTAPDAAFDSFHIEYAEPWVWGEAIVLTVPGSERSYDLTGLKPGTEYVVFIGGVKGGHNSTPLSAIFTTGGHHHHHH

SEQ ID NO: 1177 - protein, 98 aa, Artificial
  Synthetic TENCON_HIS
MLPAPKNLVVSRVTEDSARLSWTAPDAAFDSFLIQYQESEKVGEAIVLTVPGSERSYDLTGLKPGTEYTVSIYGVKGGHRSNPLSAIFTTGGHHHHHH

SEQ ID NO: 1178 - protein, 208 aa, Artificial
  Synthetic Luk047007
MLPAPKNLVVSRVTEDSARLSWTAPDAAFDSFHIEYWEQSIVGEAIVLTVPGSERSYDLTGLKPGTEYRVWIYGVKGGNDSWPLSAIFTTGGGGSGGGGSGGGGSGGGGSMLPAPKNLVVSRVTEDSARLSWTAPDAAFDSFWITYEEKFYRGEAIVLTVPGSERSYDLTGLKPGTEYKVWIVGVKGGQGSWPLSAIFTTGGHHHHHH

SEQ ID NO: 1179 - protein, 170 aa, Artificial
  Synthetic Luk047008
MTIDEWLLKEAKEKAIEELKKAGITSDYYFDLINKAKTVEGVNALKDEILKAGGGGSGGGGSGGGGSGGGGSMLPAPKNLVVSRVTEDSARLSWTAPDAAFDSFWITYEEKFYRGEAIVLTVPGSERSYDLTGLKPGTEYKVWIVGVKGGQGSWPLSAIFTTGGHHHHHH

SEQ ID NO: 1180 - protein, 208 aa, Artificial
  Synthetic Luk047009
MLPAPKNLVVSRVTEDSARLSWTAPDAAFDSFAIEYEELRDWGEAIVLTVPGSERSYDLTGLKPGTEYSVSITGVKGGAESWPLSAIFTTGGGGSGGGGSGGGGSGGGGSMLPAPKNLVVSRVTEDSARLSWTAPDAAFDSFWITYEEKFYRGEAIVLTVPGSERSYDLTGLKPGTEYKVWIVGVKGGQGSWPLSAIFTTGGHHHHHH

SEQ ID NO: 1181 - protein, 213 aa, Artificial
  Synthetic Luk047010
MLPAPKNLVVSRVTEDSARLSWTAPDAAFDSFHIEYWEQSIVGEAIVLTVPGSERSYDLTGLKPGTEYRVWIYGVKGGNDSWPLSAIFTTGGGGSGGGGSGGGGSGGGGSMLPAPKNLVVSRVTEDSARLSWYHAIHRLNHFDSFLIQYQESEKVGEAIVLTVPGSERSYDLAGLKPGTEYTVSIYGVLPDAFVSSNPLSAIFTTGGHHHHHH

SEQ ID NO: 1182 - protein, 175 aa, Artificial
  Synthetic Luk047011
MTIDEWLLKEAKEKAIEELKKAGITSDYYFDLINKAKTVEGVNALKDEILKAGGGGSGGGGSGGGGSGGGGSMLPAPKNLVVSRVTEDSARLSWYHAIHRLNHFDSFLIQYQESEKVGEAIVLTVPGSERSYDLAGLKPGTEYTVSIYGVLPDAFVSSNPLSAIFTTGGHHHHHH

SEQ ID NO: 1183 - protein, 213 aa, Artificial
  Synthetic Luk047012
MLPAPKNLVVSRVTEDSARLSWTAPDAAFDSFAIEYEELRDWGEAIVLTVPGSERSYDLTGLKPGTEYSVSITGVKGGAESWPLSAIFTTGGGGSGGGGSGGGGSGGGGSMLPAPKNLVVSRVTEDSARLSWYHAIHRLNHFDSFLIQYQESEKVGEAIVLTVPGSERSYDLAGLKPGTEYTVSIYGVLPDAFVSSNPLSAIFTTGGHHHHHH

SEQ ID NO: 1184 - protein, 208 aa, Artificial
  Synthetic Luk047013
MLPAPKNLVVSRVTEDSARLSWTAPDAAFDSFHIEYWEQSIVGEAIVLTVPGSERSYDLTGLKPGTEYRVWIYGVKGGNDSWPLSAIFTTGGGGSGGGGSGGGGSGGGGSMLPAPKNLVVSRVTEDSARLSWTAPDAAFDSFPIVYQEWQFYGEAIVLTVPGSERSYDLTGLKPGTEYLVDIYGVKGGSWSYPLSAIFTTGGHHHHHH

SEQ ID NO: 1185 - protein, 170 aa, Artificial
  Synthetic Luk047014
MTIDEWLLKEAKEKAIEELKKAGITSDYYFDLINKAKTVEGVNALKDEILKAGGGGSGGGGSGGGGSGGGGSMLPAPKNLVVSRVTEDSARLSWTAPDAAFDSFPIVYQEWQFYGEAIVLTVPGSERSYDLTGLKPGTEYLVDIYGVKGGSWSYPLSAIFTTGGHHHHHH

SEQ ID NO: 1186 - protein, 208 aa, Artificial
  Synthetic Luk047015
MLPAPKNLVVSRVTEDSARLSWTAPDAAFDSFAIEYEELRDWGEAIVLTVPGSERSYDLTGLKPGTEYSVSITGVKGGAESWPLSAIFTTGGGGSGGGGSGGGGSGGGGSMLPAPKNLVVSRVTEDSARLSWTAPDAAFDSFPIVYQEWQFYGEAIVLTVPGSERSYDLTGLKPGTEYLVDIYGVKGGSWSYPLSAIFTTGGHHHHHH

SEQ ID NO: 1187 - protein, 218 aa, Artificial
  Synthetic Luk047016
MLPAPKNLVVSRVTEDSARLSWTAPDAAFDSFHIEYWEQSIVGEAIVLTVPGSERSYDLTGLKPGTEYRVWIYGVKGGNDSWPLSAIFTTGGGGSGGGGSGGGGSGGGGSMLPAPNNLVVSRVTEDSARLSWDWDKYYTNRFDSFLIQYQESEKVGEAIVLTVPGSERSYDLTGLKPGTEYTVSIYGVLVRDYIRAAEWYSNPLSAIFTTGGHHHHHH

SEQ ID NO: 1188 - protein, 180 aa, Artificial
  Synthetic Luk047017
MTIDEWLLKEAKEKAIEELKKAGITSDYYFDLINKAKTVEGVNALKDEILKAGGGGSGGGGSGGGGSGGGGSMLPAPNNLVVSRVTEDSARLSWDWDKYYTNRFDSFLIQYQESEKVGEAIVLTVPGSERSYDLTGLKPGTEYTVSIYGVLVRDYIRAAEWYSNPLSAIFTTGGHHHHHH

SEQ ID NO: 1189 - protein, 218 aa, Artificial
  Synthetic Luk047018
MLPAPKNLVVSRVTEDSARLSWTAPDAAFDSFAIEYEELRDWGEAIVLTVPGSERSYDLTGLKPGTEYSVSITGVKGGAESWPLSAIFTTGGGGSGGGGSGGGGSGGGGSMLPAPNNLVVSRVTEDSARLSWDWDKYYTNRFDSFLIQYQESEKVGEAIVLTVPGSERSYDLTGLKPGTEYTVSIYGVLVRDYIRAAEWYSNPLSAIFTTGGHHHHHH

SEQ ID NO: 1190 - protein, 215 aa, Artificial
  Synthetic Luk047019
MLPAPKNLVVSRVTEDSARLSWTAPDAAFDSFHIEYWEQSIVGEAIVLTVPGSERSYDLTGLKPGTEYRVWIYGVKGGNDSWPLSAIFTTGGGGSGGGGSGGGGSGGGGSMLPAPKNLVVSRVTEDSARLSWYHENAYLLFDSFLIQYQESEKVGEAIVLTVPGSERSYDLTGLKPGTEYTVSIYGVVYDLTPEKRSSNPLSAIFTTGGHHHHHH

SEQ ID NO: 1191 - protein, 177 aa, Artificial
  Synthetic Luk047020
MTIDEWLLKEAKEKAIEELKKAGITSDYYFDLINKAKTVEGVNALKDEILKAGGGGSGGGGSGGGGSGGGGSMLPAPKNLVVSRVTEDSARLSWYHENAYLLFDSFLIQYQESEKVGEAIVLTVPGSERSYDLTGLKPGTEYTVSIYGVVYDLTPEKRSSNPLSAIFTTGGHHHHHH

SEQ ID NO: 1192 - protein, 215 aa, Artificial
  Synthetic Luk047021
MLPAPKNLVVSRVTEDSARLSWTAPDAAFDSFAIEYEELRDWGEAIVLTVPGSERSYDLTGLKPGTEYSVSITGVKGGAESWPLSAIFTTGGGGSGGGGSGGGGSGGGGSMLPAPKNLVVSRVTEDSARLSWYHENAYLLFDSFLIQYQESEKVGEAIVLTVPGSERSYDLTGLKPGTEYTVSIYGVVYDLTPEKRSSNPLSAIFTTGGHHHHHH

SEQ ID NO: 1193 - protein, 215 aa, Artificial
  Synthetic Luk047022
MLPAPKNLVVSRVTEDSARLSWTAPDAAFDSFHIEYWEQSIVGEAIVLTVPGSERSYDLTGLKPGTEYRVWIYGVKGGNDSWPLSAIFTTGGGGSGGGGSGGGGSGGGGSMLPAPKNLVVSRVTEDSARLSWTAPDAAFDSFLIQYQESEKVGEAIVLTVPGSERSYDLTGLKPGTEYTVSIYGVELIYHGWLDFVFSNPLSAIFTTGGHHHHHH

SEQ ID NO: 1194 - protein, 177 aa, Artificial
  Synthetic Luk047023
MTIDEWLLKEAKEKAIEELKKAGITSDYYFDLINKAKTVEGVNALKDEILKAGGGGSGGGGSGGGGSGGGGSMLPAPKNLVVSRVTEDSARLSWTAPDAAFDSFLIQYQESEKVGEAIVLTVPGSERSYDLTGLKPGTEYTVSIYGVELIYHGWLDFVFSNPLSAIFTTGGHHHHHH

SEQ ID NO: 1195 - protein, 215 aa, Artificial
  Synthetic Luk047024
MLPAPKNLVVSRVTEDSARLSWTAPDAAFDSFAIEYEELRDWGEAIVLTVPGSERSYDLTGLKPGTEYSVSITGVKGGAESWPLSAIFTTGGGGSGGGGSGGGGSGGGGSMLPAPKNLVVSRVTEDSARLSWTAPDAAFDSFLIQYQESEKVGEAIVLTVPGSERSYDLTGLKPGTEYTVSIYGVELIYHGWLDFVFSNPLSAIFTTGGHHHHHH

SEQ ID NO: 1196 - protein, 208 aa, Artificial
  Synthetic Luk047025
MLPAPKNLVVSRVTEDSARLSWTAPDAAFDSFHIEYWEQSIVGEAIVLTVPGSERSYDLTGLKPGTEYRVWIYGVKGGNDSWPLSAIFTTGGGGSGGGGSGGGGSGGGGSMLPAPKNLVVSRVTEDSARLSWTAPDAAFDSFYIEYWEPTSDGEAIALNVPGSERSYDLTGLKPGTEYFVEIWGVKGGPRSPPLSAWFTTGGHHHHHH

SEQ ID NO: 1197 - protein, 170 aa, Artificial
  Synthetic Luk047026
MTIDEWLLKEAKEKAIEELKKAGITSDYYFDLINKAKTVEGVNALKDEILKAGGGGSGGGGSGGGGSGGGGSMLPAPKNLVVSRVTEDSARLSWTAPDAAFDSFYIEYWEPTSDGEAIALNVPGSERSYDLTGLKPGTEYFVEIWGVKGGPRSPPLSAWFTTGGHHHHHH

SEQ ID NO: 1198 - protein, 208 aa, Artificial
  Synthetic Luk047027
MLPAPKNLVVSRVTEDSARLSWTAPDAAFDSFAIEYEELRDWGEAIVLTVPGSERSYDLTGLKPGTEYSVSITGVKGGAESWPLSAIFTTGGGGSGGGGSGGGGSGGGGSMLPAPKNLVVSRVTEDSARLSWTAPDAAFDSFYIEYWEPTSDGEAIALNVPGSERSYDLTGLKPGTEYFVEIWGVKGGPRSPPLSAWFTTGGHHHHHH

SEQ ID NO: 1199 - protein, 208 aa, Artificial
  Synthetic Luk047028
MLPAPKNLVVSRVTEDSARLSWTAPDAAFDSFHIEYWEQSIVGEAIVLTVPGSERSYDLTGLKPGTEYRVWIYGVKGGNDSWPLSAIFTTGGGGSGGGGSGGGGSGGGGSMLPAPKNLVVSRVTEDSARLSWTAPDAAFDSFDIEYGEPEKIGEAIWLTVPGSERSYDLTGLKPGTEYWVFIYGVKGGALSRPLTATFTTGGHHHHHH

SEQ ID NO: 1200 - protein, 170 aa, Artificial
  Synthetic Luk047029
MTIDEWLLKEAKEKAIEELKKAGITSDYYFDLINKAKTVEGVNALKDEILKAGGGGSGGGGSGGGGSGGGGSMLPAPKNLVVSRVTEDSARLSWTAPDAAFDSFDIEYGEPEKIGEAIWLTVPGSERSYDLTGLKPGTEYWVFIYGVKGGALSRPLTATFTTGGHHHHHH

SEQ ID NO: 1201 - protein, 208 aa, Artificial
  Synthetic Luk047030
MLPAPKNLVVSRVTEDSARLSWTAPDAAFDSFAIEYEELRDWGEAIVLTVPGSERSYDLTGLKPGTEYSVSITGVKGGAESWPLSAIFTTGGGGSGGGGSGGGGSGGGGSMLPAPKNLVVSRVTEDSARLSWTAPDAAFDSFDIEYGEPEKIGEAIWLTVPGSERSYDLTGLKPGTEYWVFIYGVKGGALSRPLTATFTTGGHHHHHH

SEQ ID NO: 1202 - protein, 208 aa, Artificial
  Synthetic Luk047031
MLPAPKNLVVSRVTEDSARLSWTAPDAAFDSFHIEYWEQSIVGEAIVLTVPGSERSYDLTGLKPGTEYRVWIYGVKGGNDSWPLSAIFTTGGGGSGGGGSGGGGSGGGGSMLPAPKNLVVSRVTEDSARLSWTAPDAAFDSFRILYFEYKRLGEAIVLTVPGSERSYDLTGLKPGTEYFVGIHGVKGGYISRPLSAIFTTGGHHHHHH

SEQ ID NO: 1203 - protein, 170 aa, Artificial
  Synthetic Luk047032
MTIDEWLLKEAKEKAIEELKKAGITSDYYFDLINKAKTVEGVNALKDEILKAGGGGSGGGGSGGGGSGGGGSMLPAPKNLVVSRVTEDSARLSWTAPDAAFDSFRILYFEYKRLGEAIVLTVPGSERSYDLTGLKPGTEYFVGIHGVKGGYISRPLSAIFTTGGHHHHHH

SEQ ID NO: 1204 - protein, 208 aa, Artificial
  Synthetic Luk047033
MLPAPKNLVVSRVTEDSARLSWTAPDAAFDSFAIEYEELRDWGEAIVLTVPGSERSYDLTGLKPGTEYSVSITGVKGGAESWPLSAIFTTGGGGSGGGGSGGGGSGGGGSMLPAPKNLVVSRVTEDSARLSWTAPDAAFDSFRILYFEYKRLGEAIVLTVPGSERSYDLTGLKPGTEYFVGIHGVKGGYISRPLSAIFTTGGHHHHHH

SEQ ID NO: 1205 - protein, 208 aa, Artificial
  Synthetic Luk047034
MLPAPKNLVVSRVTEDSARLSWTAPDAAFDSFHIEYWEQSIVGEAIVLTVPGSERSYDLTGLKPGTEYRVWIYGVKGGNDSWPLSAIFTTGGGGSGGGGSGGGGSGGGGSMLPAPKNLVVSRVTEDSARLSWTAPDAAFDSFHIHYWEFNPAGEAIVLTVPGSERSYDLTGLKPGTEYFVGIHGVKGGGISWPLSAIFTTGGHHHHHH

SEQ ID NO: 1206 - protein, 170 aa, Artificial
  Synthetic Luk047035
MTIDEWLLKEAKEKAIEELKKAGITSDYYFDLINKAKTVEGVNALKDEILKAGGGGSGGGGSGGGGSGGGGSMLPAPKNLVVSRVTEDSARLSWTAPDAAFDSFHIHYWEFNPAGEAIVLTVPGSERSYDLTGLKPGTEYFVGIHGVKGGGISWPLSAIFTTGGHHHHHH

SEQ ID NO: 1207 - protein, 208 aa, Artificial
  Synthetic Luk047036
MLPAPKNLVVSRVTEDSARLSWTAPDAAFDSFAIEYEELRDWGEAIVLTVPGSERSYDLTGLKPGTEYSVSITGVKGGAESWPLSAIFTTGGGGSGGGGSGGGGSGGGGSMLPAPKNLVVSRVTEDSARLSWTAPDAAFDSFHIHYWEFNPAGEAIVLTVPGSERSYDLTGLKPGTEYFVGIHGVKGGGISWPLSAIFTTGGHHHHHH

SEQ ID NO: 1208 - protein, 208 aa, Artificial
  Synthetic Luk047037
MLPAPKNLVVSRVTEDSARLSWTAPDAAFDSFHIEYWEQSIVGEAIVLTVPGSERSYDLTGLKPGTEYRVWIYGVKGGNDSWPLSAIFTTGGGGSGGGGSGGGGSGGGGSMLPAPKNLVVSRVTEDSARLSWTAPDAAFDSFHIFYHETDAYGEAIVLTVPGSERSYDLTGLKPGTEYFVVIHGVKGGFISSPLSAIFTTGGHHHHHH

SEQ ID NO: 1209 - protein, 170 aa, Artificial
  Synthetic Luk047038
MTIDEWLLKEAKEKAIEELKKAGITSDYYFDLINKAKTVEGVNALKDEILKAGGGGSGGGGSGGGGSGGGGSMLPAPKNLVVSRVTEDSARLSWTAPDAAFDSFHIFYHETDAYGEAIVLTVPGSERSYDLTGLKPGTEYFVVIHGVKGGFISSPLSAIFTTGGHHHHHH

SEQ ID NO: 1210 - protein, 208 aa, Artificial
  Synthetic Luk047039
MLPAPKNLVVSRVTEDSARLSWTAPDAAFDSFAIEYEELRDWGEAIVLTVPGSERSYDLTGLKPGTEYSVSITGVKGGAESWPLSAIFTTGGGGSGGGGSGGGGSGGGGSMLPAPKNLVVSRVTEDSARLSWTAPDAAFDSFHIFYHETDAYGEAIVLTVPGSERSYDLTGLKPGTEYFVVIHGVKGGFISSPLSAIFTTGGHHHHHH

SEQ ID NO: 1211 - protein, 207 aa, Artificial
  Synthetic Luk047040
MLPAPKNLVVSRVTEDSARLSWTAPDAAFDSFHIEYWEQSIVGEAIVLTVPGSERSYDLTGLKPGTEYRVWIYGVKGGNDSWPLSAIFTTGGGGSGGGGSGGGGSGGGGSMLPAPKNLVVSRVTEDSARLSWTAPDAAFDSFWISYVEPDDGEAIELLVPGSERSYDLTGLKPGTEYIVQIDGVKGGTTSVPLNARFTTGGHHHHHH

SEQ ID NO: 1212 - protein, 169 aa, Artificial
  Synthetic Luk047041
MTIDEWLLKEAKEKAIEELKKAGITSDYYFDLINKAKTVEGVNALKDEILKAGGGGSGGGGSGGGGSGGGGSMLPAPKNLVVSRVTEDSARLSWTAPDAAFDSFWISYVEPDDGEAIELLVPGSERSYDLTGLKPGTEYIVQIDGVKGGTTSVPLNARFTTGGHHHHHH

SEQ ID NO: 1213 - protein, 207 aa, Artificial
  Synthetic Luk047042
MLPAPKNLVVSRVTEDSARLSWTAPDAAFDSFAIEYEELRDWGEAIVLTVPGSERSYDLTGLKPGTEYSVSITGVKGGAESWPLSAIFTTGGGGSGGGGSGGGGSGGGGSMLPAPKNLVVSRVTEDSARLSWTAPDAAFDSFWISYVEPDDGEAIELLVPGSERSYDLTGLKPGTEYIVQIDGVKGGTTSVPLNARFTTGGHHHHHH

SEQ ID NO: 1214 - protein, 208 aa, Artificial
  Synthetic Luk047043
MLPAPKNLVVSRVTEDSARLSWTAPDAAFDSFHIEYWEQSIVGEAIVLTVPGSERSYDLTGLKPGTEYRVWIYGVKGGNDSWPLSAIFTTGGGGSGGGGSGGGGSGGGGSMLPAPKNLVVSRVTEDSARLSWTAPDAAFDSFGIGYLEYPWYGEAIVLTVPGSERSYDLTGLKPGTEYFVDIYGVKGGWWSYPLSAIFTTGGHHHHHH

SEQ ID NO: 1215 - protein, 170 aa, Artificial
  Synthetic Luk047044
MTIDEWLLKEAKEKAIEELKKAGITSDYYFDLINKAKTVEGVNALKDEILKAGGGGSGGGGSGGGGSGGGGSMLPAPKNLVVSRVTEDSARLSWTAPDAAFDSFGIGYLEYPWYGEAIVLTVPGSERSYDLTGLKPGTEYFVDIYGVKGGWWSYPLSAIFTTGGHHHHHH

SEQ ID NO: 1216 - protein, 208 aa, Artificial
  Synthetic Luk047045
MLPAPKNLVVSRVTEDSARLSWTAPDAAFDSFAIEYEELRDWGEAIVLTVPGSERSYDLTGLKPGTEYSVSITGVKGGAESWPLSAIFTTGGGGSGGGGSGGGGSGGGGSMLPAPKNLVVSRVTEDSARLSWTAPDAAFDSFGIGYLEYPWYGEAIVLTVPGSERSYDLTGLKPGTEYFVDIYGVKGGWWSYPLSAIFTTGGHHHHHH

SEQ ID NO: 1217 - protein, 208 aa, Artificial
  Synthetic Luk047046
MLPAPKNLVVSRVTEDSARLSWTAPDAAFDSFHIEYWEQSIVGEAIVLTVPGSERSYDLTGLKPGTEYRVWIYGVKGGNDSWPLSAIFTTGGGGSGGGGSGGGGSGGGGSMLPAPKNLVVSRVTEDSARLSWTAPDAAFDSFNIDYFEYYEFGEAIVLTVPGSERSYDLTGLKPGTEYFVDIYGVKGGSWSLPLSAIFTTGGHHHHHH

SEQ ID NO: 1218 - protein, 170 aa, Artificial
  Synthetic Luk047047
MTIDEWLLKEAKEKAIEELKKAGITSDYYFDLINKAKTVEGVNALKDEILKAGGGGSGGGGSGGGGSGGGGSMLPAPKNLVVSRVTEDSARLSWTAPDAAFDSFNIDYFEYYEFGEAIVLTVPGSERSYDLTGLKPGTEYFVDIYGVKGGSWSLPLSAIFTTGGHHHHHH

SEQ ID NO: 1219 - protein, 208 aa, Artificial
  Synthetic Luk047048
MLPAPKNLVVSRVTEDSARLSWTAPDAAFDSFAIEYEELRDWGEAIVLTVPGSERSYDLTGLKPGTEYSVSITGVKGGAESWPLSAIFTTGGGGSGGGGSGGGGSGGGGSMLPAPKNLVVSRVTEDSARLSWTAPDAAFDSFNIDYFEYYEFGEAIVLTVPGSERSYDLTGLKPGTEYFVDIYGVKGGSWSLPLSAIFTTGGHHHHHH

SEQ ID NO: 1220 - protein, 208 aa, Artificial
  Synthetic Luk047049
MLPAPKNLVVSRVTEDSARLSWTAPDAAFDSFHIEYWEQSIVGEAIVLTVPGSERSYDLTGLKPGTEYRVWIYGVKGGNDSWPLSAIFTTGGGGSGGGGSGGGGSGGGGSMLPAPKNLVVSRVTEDSARLSWTAPDAAFDSFDISYDEYPEFGEAIVLTVPGSERSYDLTGLKPGTEYLVDIIGVKGGEISLPLSAIFTTGGHHHHHH

SEQ ID NO: 1221 - protein, 170 aa, Artificial
  Synthetic Luk047050
MTIDEWLLKEAKEKAIEELKKAGITSDYYFDLINKAKTVEGVNALKDEILKAGGGGSGGGGSGGGGSGGGGSMLPAPKNLVVSRVTEDSARLSWTAPDAAFDSFDISYDEYPEFGEAIVLTVPGSERSYDLTGLKPGTEYLVDIIGVKGGEISLPLSAIFTTGGHHHHHH

SEQ ID NO: 1222 - protein, 208 aa, Artificial
  Synthetic Luk047051
MLPAPKNLVVSRVTEDSARLSWTAPDAAFDSFAIEYEELRDWGEAIVLTVPGSERSYDLTGLKPGTEYSVSITGVKGGAESWPLSAIFTTGGGGSGGGGSGGGGSGGGGSMLPAPKNLVVSRVTEDSARLSWTAPDAAFDSFDISYDEYPEFGEAIVLTVPGSERSYDLTGLKPGTEYLVDIIGVKGGEISLPLSAIFTTGGHHHHHH

SEQ ID NO: 1223 - protein, 208 aa, Artificial
  Synthetic Luk047052
MLPAPKNLVVSRVTEDSARLSWTAPDAAFDSFHIEYWEQSIVGEAIVLTVPGSERSYDLTGLKPGTEYRVWIYGVKGGNDSWPLSAIFTTGGGGSGGGGSGGGGSGGGGSMLPAPKNLVVSRVTEDSARLSWTAPDAAFDSFNIHYAEYPDFGEAIVLTVPGSERSYDLTGLKPGTEYIVDIWGVKGGLGSWPLSAIFTTGGHHHHHH

SEQ ID NO: 1224 - protein, 170 aa, Artificial
  Synthetic Luk047053
MTIDEWLLKEAKEKAIEELKKAGITSDYYFDLINKAKTVEGVNALKDEILKAGGGGSGGGGSGGGGSGGGGSMLPAPKNLVVSRVTEDSARLSWTAPDAAFDSFNIHYAEYPDFGEAIVLTVPGSERSYDLTGLKPGTEYIVDIWGVKGGLGSWPLSAIFTTGGHHHHHH

SEQ ID NO: 1225 - protein, 208 aa, Artificial
  Synthetic Luk047054
MLPAPKNLVVSRVTEDSARLSWTAPDAAFDSFAIEYEELRDWGEAIVLTVPGSERSYDLTGLKPGTEYSVSITGVKGGAESWPLSAIFTTGGGGSGGGGSGGGGSGGGGSMLPAPKNLVVSRVTEDSARLSWTAPDAAFDSFNIHYAEYPDFGEAIVLTVPGSERSYDLTGLKPGTEYIVDIWGVKGGLGSWPLSAIFTTGGHHHHHH

SEQ ID NO: 1226 - protein, 208 aa, Artificial
  Synthetic Luk047055
MLPAPKNLVVSRVTEDSARLSWTAPDAAFDSFHIEYWEQSIVGEAIVLTVPGSERSYDLTGLKPGTEYRVWIYGVKGGNDSWPLSAIFTTGGGGSGGGGSGGGGSGGGGSMLPAPKNLVVSRVTEDSARLSWTAPDAAFDSFVIFYGEYENGGEAIVLTVPGSERSYDLTGLKPGTEYFVIIVGVKGGFDSKPLSAIFTTGGHHHHHH

SEQ ID NO: 1227 - protein, 170 aa, Artificial
  Synthetic Luk047056
MTIDEWLLKEAKEKAIEELKKAGITSDYYFDLINKAKTVEGVNALKDEILKAGGGGSGGGGSGGGGSGGGGSMLPAPKNLVVSRVTEDSARLSWTAPDAAFDSFVIFYGEYENGGEAIVLTVPGSERSYDLTGLKPGTEYFVIIVGVKGGFDSKPLSAIFTTGGHHHHHH

SEQ ID NO: 1228 - protein, 208 aa, Artificial
  Synthetic Luk047057
MLPAPKNLVVSRVTEDSARLSWTAPDAAFDSFAIEYEELRDWGEAIVLTVPGSERSYDLTGLKPGTEYSVSITGVKGGAESWPLSAIFTTGGGGSGGGGSGGGGSGGGGSMLPAPKNLVVSRVTEDSARLSWTAPDAAFDSFVIFYGEYENGGEAIVLTVPGSERSYDLTGLKPGTEYFVIIVGVKGGFDSKPLSAIFTTGGHHHHHH

SEQ ID NO: 1229 - protein, 208 aa, Artificial
  Synthetic Luk047058
MLPAPKNLVVSRVTEDSARLSWTAPDAAFDSFHIEYWEQSIVGEAIVLTVPGSERSYDLTGLKPGTEYRVWIYGVKGGNDSWPLSAIFTTGGGGSGGGGSGGGGSGGGGSMLPAPKNLVVSRVTEDSARLSWTAPDAAFDSFQIFYQEVVEWGEAIVLTVPGSERSYDLTGLKPGTEYFVVIHGVKGGWISDPLSAIFTTGGHHHHHH

SEQ ID NO: 1230 - protein, 170 aa, Artificial
  Synthetic Luk047059
MTIDEWLLKEAKEKAIEELKKAGITSDYYFDLINKAKTVEGVNALKDEILKAGGGGSGGGGSGGGGSGGGGSMLPAPKNLVVSRVTEDSARLSWTAPDAAFDSFQIFYQEVVEWGEAIVLTVPGSERSYDLTGLKPGTEYFVVIHGVKGGWISDPLSAIFTTGGHHHHHH

SEQ ID NO: 1231 - protein, 208 aa, Artificial
  Synthetic Luk047060
MLPAPKNLVVSRVTEDSARLSWTAPDAAFDSFAIEYEELRDWGEAIVLTVPGSERSYDLTGLKPGTEYSVSITGVKGGAESWPLSAIFTTGGGGSGGGGSGGGGSGGGGSMLPAPKNLVVSRVTEDSARLSWTAPDAAFDSFQIFYQEVVEWGEAIVLTVPGSERSYDLTGLKPGTEYFVVIHGVKGGWISDPLSAIFTTGGHHHHHH

SEQ ID NO: 1232 - protein, 208 aa, Artificial
  Synthetic Luk047061
MLPAPKNLVVSRVTEDSARLSWTAPDAAFDSFHIEYWEQSIVGEAIVLTVPGSERSYDLTGLKPGTEYRVWIYGVKGGNDSWPLSAIFTTGGGGSGGGGSGGGGSGGGGSMLPAPKNLVVSRVTEDSARLSWTAPDAAFDSFAIFYVELVWKGEAIVLTVPGSERSYDLTGLKPGTEYFVVIHGVKGGYISDPLSAIFTTGGHHHHHH

SEQ ID NO: 1233 - protein, 170 aa, Artificial
  Synthetic Luk047062
MTIDEWLLKEAKEKAIEELKKAGITSDYYFDLINKAKTVEGVNALKDEILKAGGGGSGGGGSGGGGSGGGGSMLPAPKNLVVSRVTEDSARLSWTAPDAAFDSFAIFYVELVWKGEAIVLTVPGSERSYDLTGLKPGTEYFVVIHGVKGGYISDPLSAIFTTGGHHHHHH

SEQ ID NO: 1234 - protein, 208 aa, Artificial
  Synthetic Luk047063
MLPAPKNLVVSRVTEDSARLSWTAPDAAFDSFAIEYEELRDWGEAIVLTVPGSERSYDLTGLKPGTEYSVSITGVKGGAESWPLSAIFTTGGGGSGGGGSGGGGSGGGGSMLPAPKNLVVSRVTEDSARLSWTAPDAAFDSFAIFYVELVWKGEAIVLTVPGSERSYDLTGLKPGTEYFVVIHGVKGGYISDPLSAIFTTGGHHHHHH

SEQ ID NO: 1235 - protein, 208 aa, Artificial
  Synthetic Luk047064
MLPAPKNLVVSRVTEDSARLSWTAPDAAFDSFHIEYWEQSIVGEAIVLTVPGSERSYDLTGLKPGTEYRVWIYGVKGGNDSWPLSAIFTTGGGGSGGGGSGGGGSGGGGSMLPAPKNLVVSRVTEDSARLSWTAPDAAFDSFVIFYHETRVTGEAIVLTVPGSERSYDLTGLKPGTEYLVVIHGVKGGYISEPLSAIFTTGGHHHHHH

SEQ ID NO: 1236 - protein, 170 aa, Artificial
  Synthetic Luk047065
MTIDEWLLKEAKEKAIEELKKAGITSDYYFDLINKAKTVEGVNALKDEILKAGGGGSGGGGSGGGGSGGGGSMLPAPKNLVVSRVTEDSARLSWTAPDAAFDSFVIFYHETRVTGEAIVLTVPGSERSYDLTGLKPGTEYLVVIHGVKGGYISEPLSAIFTTGGHHHHHH

SEQ ID NO: 1237 - protein, 208 aa, Artificial
  Synthetic Luk047066
MLPAPKNLVVSRVTEDSARLSWTAPDAAFDSFAIEYEELRDWGEAIVLTVPGSERSYDLTGLKPGTEYSVSITGVKGGAESWPLSAIFTTGGGGSGGGGSGGGGSGGGGSMLPAPKNLVVSRVTEDSARLSWTAPDAAFDSFVIFYHETRVTGEAIVLTVPGSERSYDLTGLKPGTEYLVVIHGVKGGYISEPLSAIFTTGGHHHHHH

SEQ ID NO: 1238 - protein, 208 aa, Artificial
  Synthetic Luk047067
MLPAPKNLVVSRVTEDSARLSWTAPDAAFDSFHIEYWEQSIVGEAIVLTVPGSERSYDLTGLKPGTEYRVWIYGVKGGNDSWPLSAIFTTGGGGSGGGGSGGGGSGGGGSMLPAPKNLVVSRVTEDSARLSWTAPDAAFDSFLIDYWEGEFDGEAIHLFVPGSERSYDLTGLKPGTEYDVFIVGVKGGHGSDPLSAIFTTGGHHHHHH

SEQ ID NO: 1239 - protein, 170 aa, Artificial
  Synthetic Luk047068
MTIDEWLLKEAKEKAIEELKKAGITSDYYFDLINKAKTVEGVNALKDEILKAGGGGSGGGGSGGGGSGGGGSMLPAPKNLVVSRVTEDSARLSWTAPDAAFDSFLIDYWEGEFDGEAIHLFVPGSERSYDLTGLKPGTEYDVFIVGVKGGHGSDPLSAIFTTGGHHHHHH

SEQ ID NO: 1240 - protein, 208 aa, Artificial
  Synthetic Luk047069
MLPAPKNLVVSRVTEDSARLSWTAPDAAFDSFAIEYEELRDWGEAIVLTVPGSERSYDLTGLKPGTEYSVSITGVKGGAESWPLSAIFTTGGGGSGGGGSGGGGSGGGGSMLPAPKNLVVSRVTEDSARLSWTAPDAAFDSFLIDYWEGEFDGEAIHLFVPGSERSYDLTGLKPGTEYDVFIVGVKGGHGSDPLSAIFTTGGHHHHHH

SEQ ID NO: 1241 - protein, 89 aa, Artificial
  Synthetic TENCON parent
LPAPKNLVVSRVTEDSARLSWTAPDAAFDSFLIQYQESEKVGEAIVLTVPGSERSYDLTGLKPGTEYTVSIYGVKGGHRSNPLSAIFTT

SEQ ID NO: 1242 - protein, 120 aa, Homo sapiens
EVQLVETGGGLVKPGGSLRLSCSASRFSFRDYYMTWIRQAPGKGPEWVSHISGSGSTIYYADSVRGRFTISRDNAKSSLYLQMDSLQADDTAVYYCARGGRATSYYWVHWGPGTLVTVSS

SEQ ID NO: 1243 - protein, 107 aa, Homo sapiens
EIVLTQSPATLSLSPGERATLSCRASQSVSGYLGWYQQKPGQAPRLLIYGASSRATGIPDRFSGSGSGTDFTLTISRLEPEDFAVYYCQQYGSSPLTFGGGTKLEIK

What is claimed:

1. A Leukocidin B (LukB) polypeptide comprising an amino acid sequence corresponding to amino acid residues 1-109 of SEQ ID NO: 1026 coupled to amino acid residues 152-305 of SEQ ID NO: 1026, wherein said LukB polypeptide does not comprise one or more amino acid residues corresponding to amino acid residues 110-151 of SEQ ID NO: 1026.

2. A recombinant Leukocidin A (LukA) polypeptide comprising an amino acid sequence corresponding to amino acid residues 1-134 of SEQ ID NO: 1018 coupled to amino acid residues 175-324 of SEQ ID NO: 1018, wherein the amino acid residue corresponding to amino acid residue 323 of SEQ ID NO: 1018 is selected from glutamic acid and alanine, and wherein said LukA polypeptide does not comprise one or more amino acid residues corresponding to amino acid residues 135-174 of SEQ ID NO: 1018.

3. A vaccine composition comprising:
a recombinant Leukocidin B (LukB) polypeptide comprising an amino acid sequence corresponding to amino acid residues 1-109 of SEQ ID NO: 1026 coupled to amino acid residues 152-305 of SEQ ID NO: 1026, wherein said LukB polypeptide does not comprise one or more amino acid residues corresponding to amino acid residues 110-151 of SEQ ID NO: 1026; and
a recombinant Leukocidin A (LukA) polypeptide comprising an amino acid sequence corresponding to amino acid residues 1-134 of SEQ ID NO: 1018 coupled to amino acid residues 175-324 of SEQ ID NO: 1018, wherein the amino acid residue corresponding to amino acid residue 323 of SEQ ID NO: 1018 is selected from glutamic acid and alanine, and wherein said LukA polypeptide does not comprise one or more amino acid residues corresponding to amino acid residues 135-174 of SEQ ID NO: 1018.

4. The vaccine composition of claim 3, wherein said recombinant LukB polypeptide does not comprise amino acid residues corresponding to amino acid residues 122-126 of SEQ ID NO: 1026, amino acid residues 130-134 of SEQ ID NO: 1026, or amino acid residues 110-151 of SEQ ID NO: 1026.

5. The vaccine composition of claim 3, wherein said recombinant LukB polypeptide comprises an amino acid sequence of SEQ ID NO: 1029, SEQ ID NO: 1030, SEQ ID NO: 1031, SEQ ID NO: 1032, SEQ ID NO: 1150, or SEQ ID NO: 1151.

6. The vaccine composition of claim 3, wherein said recombinant LukA polypeptide comprises an alanine at the amino acid residue corresponding to amino acid residue 323 of SEQ ID NO: 1018.

7. The vaccine composition of claim 3, wherein said recombinant LukA polypeptide does not comprise amino acid residues corresponding to amino acid residues 144-149 of SEQ ID NO: 1018 or amino acid residues 135-174 of SEQ ID NO: 1018.

8. The vaccine composition of claim 3, wherein said LukA polypeptide comprises an amino acid sequence SEQ ID NO: 1022, SEQ ID NO: 1023, SEQ ID NO: 1024, SEQ ID NO: 1025, or SEQ ID NO: 1149.

9. The recombinant LukB polypeptide of claim 1, wherein amino acid residues corresponding to amino acid residues 1-109 of SEQ ID NO: 1026 are coupled to amino acid residues corresponding to amino acid residues 152-305 of SEQ ID NO: 1026 via a serine/glycine-rich linker.

10. The recombinant LukB polypeptide of claim 1, wherein said LukB polypeptide does not comprise amino acid residues corresponding to amino acid residues 122-126 of SEQ ID NO: 1026, amino acid residues 130-134 of SEQ ID NO: 1026, or amino acid residues 110-151 of SEQ ID NO: 1026.

11. The recombinant LukB polypeptide of claim 1, wherein said LukB polypeptide comprises an amino acid sequence of SEQ ID NO: 1029, SEQ ID NO: 1030, SEQ ID NO: 1031, SEQ ID NO: 1032, SEQ ID NO: 1150, or SEQ ID NO: 1151.

12. The recombinant LukA polypeptide of claim 2, wherein amino acid residues corresponding to amino acid residues 1-134 of SEQ ID NO: 1018 are coupled to amino acid residues corresponding to amino acid residues 175-324 of SEQ ID NO: 1018 via a serine/glycine-rich linker.

13. The recombinant LukA polypeptide of claim 2, wherein said LukA polypeptide comprises an alanine at the amino acid residue corresponding to amino acid residue 323 of SEQ ID NO: 1018.

14. The recombinant LukA polypeptide of claim 2, wherein said LukA polypeptide does not comprise amino acid residues corresponding to amino acid residues 144-149 of SEQ ID NO: 1018 or amino acid residues 135-174 of SEQ ID NO: 1018.

15. The recombinant LukA polypeptide of claim 2, wherein said LukA polypeptide comprises an amino acid sequence of SEQ ID NO: 1022, SEQ ID NO: 1023, SEQ ID NO: 1024, SEQ ID NO: 1025, or SEQ ID NO: 1149.

* * * * *